United States Patent 11,692,002 (RNA SEQUENCE ADAPTATION) - sequence listing, part 4

SEQ ID NO: 10025 - RNA, 1701 nt, Artificial Sequence
  derived and/or modified CDS sequence (AUadapt) from InfluenzaA__AGB13159__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgccucgcugcaccuggggaagugcaacaucgccggcuggauccucgggaaccccgagugcgagucccugagcaccgcguccucgugguccuacaucguggagaccagcuccucggacaacggcacgugcuacccgggcgacuucaucgacuacgaggagcugcgggagcagcucuccucgguguccagcuucgagcgcuucgagaucuuccccaagaccuccucguggcccaaccacgacuccaacaagggggucaccgccgccugcccccacgccggcgcgaagggguucuacaagaaccugaucuggcuggugaagaagggcaacagcuacccgaagcucuccaagucguacaucaacgacaaggggaaggaggugcugguccuguggggcauccaccaccccagcaccacggccgaccagcagucccucuaccagaacgccgacaccuacguguucgugggcaccucgcgguacuccaagaaguucaagcccgagaucgccauccgccccaagguccgggaccaggaggggcgcaugaacuacuacuggacccugguggagccgggcgacaagaucacguucgaggccaccgggaaccugguggucccccgguacgcguucgccauggagcgcaacgccggcucgggcaucaucaucuccgacacccccgugcacgacugcaacaccacgugccagacccccaagggggccaucaacaccagccucccguuccagaacauccaccccaucaccaucggcaagugccccaaguacgugaaguccacgaagcugcggcuggccaccgggcuccgcaacguccccucgauccagucccggggccuguucggggcgaucgccggcuucaucgagggcggguggaccggcaugguggacgggugguacggcuaccaccaccagaacgagcaggggagcggcuacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagucggugaagaacggcaccuacgacuacccgaaguacuccgaggaggccaagcugaaccgggaggagaucgacggggugaagcuggagagcacccgcaucuaccagauccucgccaucuacuccaccgucgcgucgucccuggugcugguggucagccucggcgccaucucguucuggaugugcuccaacggcagccugcagugccggaucugcaucuga

SEQ ID NO: 10026 - RNA, 1701 nt, Artificial Sequence; identical to SEQ ID NO: 7069
  derived and/or modified CDS sequence (AUadapt) from InfluenzaA__AGB13170__HA

SEQ ID NO: 10027 - RNA, 1701 nt, Artificial Sequence
  derived and/or modified CDS sequence (AUadapt) from InfluenzaA__AGB13180__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacaccucggugcacgacugcaacacgaccugccagacccccaagggcgccaucaacaccucccugccguuccagaacauccaccccaucaccaucgggaagugccccaaguacgucaagagcaccaagcugcggcucgcgacgggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 10028 - RNA, 1701 nt, Artificial Sequence; identical to SEQ ID NO: 7112
  derived and/or modified CDS sequence (AUadapt) from InfluenzaA__AGB13190__HA

SEQ ID NO: 10029 - RNA, 1701 nt, Artificial Sequence
  derived and/or modified CDS sequence (AUadapt) from InfluenzaA__AGB13200__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgugaaguccuucuacaagaaccugaucuggcucgugaagaaggggaacucguaccccaagcuguccaagagcuacaucaacgacaagggcaaggagguccuggugcucugggggauccaccaccccucgaccacgaccgaccagcagucccuguaccagaacgcggacgccuacguguucgucggcaccucgaaguacuccaagaaguucaagcccgagaucgccauccggccgaaggugcgcgaccaggagggccggaugaacuacuacuggacccugguggagcccggggacaagaucacguucgaggccaccggcaaccucgucgugccccgcuacgccuucgcgauggagcggaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgucaaguccacgaagcugcgccucgccaccggccugcggaacgugccgagcauccagucccgcgggcuguucggcgccaucgcgggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgccgucggcaaggaguucaaccaccuggagaagcggaucgagaaccugaacaagaagguggacgacggcuuccucgacaucuggaccuacaacgcggagcugcuggugcuccuggagaacgagcgcacgcuggacuaccacgacuccaacgucaagaaccucuacgagaaggugcggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcucgagagcacccggaucuaccagauccuggccaucuacuccaccguggccucgucccuggugcucgucgugagccugggggcgaucucguucuggaugugcuccaacggcagccugcagugccgcaucugcaucuga

SEQ ID NO: 10030 - RNA, 1701 nt, Artificial Sequence
  derived and/or modified CDS sequence (AUadapt) from InfluenzaA__AGB13210__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcacguccgccgaccagcagucgcuguaccagaacgccgacgccuacguguucgugggcaccuccaaguacagcaagaaguucaagcccgagaucgccguccggccgaaggugcgcgaccaggagggccggaugaacuacuacuggacccugguggagcccggggacaagaucaccuucgaggcgacgggcaaccuccuggucccccgcuacgccuucgccauggagcggaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcuccgccuggcgacgggccugcggaacgugccguccauccagucgcgcggccucuucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcggaucgagaaccugaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 10031 - RNA, 1701 nt, Artificial Sequence
  derived and/or modified CDS sequence (AUadapt) from InfluenzaA__AGB13220__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaucagcgacaacggcacgugcuaccccggcgacuucaucaacuacgaggagcuccgggagcagcuguccucgguguccagcuucgagcgcuucgagaucuuccccaagaccuccucguggcccaaccacgacuccaacaagggggucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccacggccgaccagcagagccuguaccagaacgccgacgccuacguguucgugggcaccuccaaguacucgaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcgccucgcgacgggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacucgaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacucgaccgucgccuccagccuggugcucguggucucccugggggccaucucguucuggaugugcagcaacggcucccugcagugccgcaucugcaucuga

SEQ ID NO: 10032 - RNA, 1701 nt, Artificial Sequence
  derived and/or modified CDS sequence (AUadapt) from InfluenzaA__AGB13230__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccgccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 10033 - RNA, 1701 nt, Artificial Sequence; identical to SEQ ID NO: 7112
  derived and/or modified CDS sequence (AUadapt) from InfluenzaA__AGB13240__HA

SEQ ID NO: 10034 - RNA, 1701 nt, Artificial Sequence; identical to SEQ ID NO: 7112
  derived and/or modified CDS sequence (AUadapt) from InfluenzaA__AGB13250__HA

SEQ ID NO: 10035 - RNA, 1701 nt, Artificial Sequence
  derived and/or modified CDS sequence (AUadapt) from InfluenzaA__AGB13260__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcuccaagucguucuacaagaaccugaucuggcucgugaagaaggggaacuccuaccccaagcugagcaagucguacaucaacgacaagggcaaggaggugcugguccucugggggauccaccacccgcccacguccgccgaccagcagagccuguaccagaacgcggacgccuacguguucgugggcaccucccgguacucgaagaaguucaagcccgagaucgccauccgccccaagguccgggaccaggagggccgcaugaacuacuacuggacccugguggagcccggggacaagaucaccuucgaggccacgggcaaccucguggucccccgguacgccuucgcgauggagcgcaacgccggguccggcaucaucaucagcgacaccccggugcacgacugcaacacgaccugccagacccccaagggcgccaucaacaccucccugcccuuccagaacgugcaccccaucaccaucgggaagugcccgaaguacgucaagucgaccaagcugcggcucgccacgggccugcgcaacgugcccuccauccagagccgggggcuguucggcgccaucgcgggguucaucgagggcggcuggaccgggaugguggacggcugguacggguaccaccaccagaacgagcagggcuccggguacgccgccgaccucaagucgacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucgaucaagaacgggaccuacgacuaccccaaguacuccgaggaggccaagcugaaccgggaggagaucgacggcgugaagcucgagagcacccgcaucuaccagauccuggccaucuacuccaccgucgccucgagccuggugcucguggucucccugggggcgaucucguucuggaugugcuccaacggcagccugcagugccggaucugcaucuga

SEQ ID NO: 10036 - RNA, 1701 nt, Artificial Sequence
  derived and/or modified CDS sequence (AUadapt) from InfluenzaA__AGB13270__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgagaagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 10037 - RNA, 1701 nt, Artificial Sequence
  derived and/or modified CDS sequence (AUadapt) from InfluenzaA__AGB13280__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaacgccgaccagcagucccuguaccagaacgccgacgccuacguguucgugggcacgucgaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacggccaggggucgggcuacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggguuccuggacaucuggaccuacaacgccgagcugcucgugcugcuggagaacgagcgcacccucgacuaccacgacuccaacgugaagaaccuguacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggcgaucuacucgaccgucgccuccagccucgugcugguggucucgcugggcgccaucuccuucuggaugugcagcaacggcucccuccagugccgcaucugcaucuga

SEQ ID NO: 10038 - RNA, 1701 nt, Artificial Sequence
  derived and/or modified CDS sequence (AUadapt) from InfluenzaA__AGB13290__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggucaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagguccuggugcucugggggauccaccaccccucgaccacggccgaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgucaaguccaccaagcugcggcucgcgacgggccugcgcaacgugccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggucaacagcgugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 10039 - RNA, 1701 nt, Artificial Sequence; identical to SEQ ID NO: 7112
  derived and/or modified CDS sequence (AUadapt) from InfluenzaA__AGB13300__HA

SEQ ID NO: 10040 - RNA, 1701 nt, Artificial Sequence
  derived and/or modified CDS sequence (AUadapt) from InfluenzaA__AGB13310__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucuggggcgugcaccaccccucgaccuccgccgaccagcagagccuguaccagaacgccgacgccuacguguucgucgggacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagcacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgagccuggugcucgucgugucccugggggccaucucguucuggaugugcuccaacggcagccugcagugccggaucugcaucuga

SEQ ID NO: 10041 - RNA, 1701 nt, Artificial Sequence
  derived and/or modified CDS sequence (AUadapt) from InfluenzaA__AGB13320__HA
augaaggccauccuggugguccuccuguacaccaucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagaagaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcgccucgcgacgggccugcggaacgucccgagcauccagucccgcgggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggugaacucggucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagucggcgcgggucuaccagauccuggccaucuacuccaccguggccucgucccuggugcucgucgugagccugggggccaucucguucuggaugugcuccaacggcagccugcagugccgcaucugcaucuga

SEQ ID NO: 10042 - RNA, 1701 nt, Artificial Sequence
  derived and/or modified CDS sequence (AUadapt) from InfluenzaA__AGB13330__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaaguccuacagcaacgacaaggggaaggaggugcugguccuguggggcauccaccaccccucgaccacggccgaccagcagucccucuaccagaacgccgacaccuacguguucgugggcaccucgcgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcagcggcaucaucaucuccgacacccccgugcacgacugcaacaccacgugccagaccccgaagggggccaucaacaccucgcuccccuuccagaacauccaccccaucaccaucggcaagugccccaaguacgugaaguccacgaagcugcggcuggccaccgggcuccgcaacgucccgagcauccagucccggggccuguucggggcgaucgccggcuucaucgagggcggguggaccggcaugguggacgggugguacggcuaccaccaccagaacgagcaggggucgggcuacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagucgacccgcaucuaccagauccucgccaucuacuccaccgucgcgucgucccuggugcugguggucagccucggcgccaucucguucuggaugugcuccaacggcagccugcagugccggaucugcaucuga

SEQ ID NO: 10043 - RNA, 1701 nt, Artificial Sequence; identical to SEQ ID NO: 7112
  derived and/or modified CDS sequence (AUadapt) from InfluenzaA__AGB13340__HA

SEQ ID NO: 10044 - RNA, 1701 nt, Artificial Sequence
  derived and/or modified CDS sequence (AUadapt) from InfluenzaA__AGB13350__HA
augaaggccauccuggugguccuccuguacaccuucgccaccgcgaacgccgacacgcugugcaucggcuaccacgccaacaacucgaccgagaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgcgaggagaucgacggcgugaagcuggagagcacccggaucuaccagauccuggccaucuacuccaccgucgccucgagccucgugcugguggucucccugggggccaucucguucuggaugugcuccaacggcagccuccagugccgcaucugcaucuga

SEQ ID NO: 10045 - RNA, 1701 nt, Artificial Sequence
  derived and/or modified CDS sequence (AUadapt) from InfluenzaA__AGB13360__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagaugcuggugcuccuggagaacgagaagacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 10046 - RNA, 1701 nt, Artificial Sequence
  derived and/or modified CDS sequence (AUadapt) from InfluenzaA__AGB13380__HA
augaaggccauccuggugguccuccuguacaccuucgccaccgcgaaggccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaaccccgggucgggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucaccaacaaggugaacucggucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 10047 - RNA, 1701 nt, Artificial Sequence; identical to SEQ ID NO: 6680
  derived and/or modified CDS sequence (AUadapt) from InfluenzaA__AGB13390__HA

SEQ ID NO: 10048 - RNA, 1701 nt, Artificial Sequence; identical to SEQ ID NO: 7287
  derived and/or modified CDS sequence (AUadapt) from InfluenzaA__AGB13400__HA

SEQ ID NO: 10049 - RNA, 1701 nt, Artificial Sequence; identical to SEQ ID NO: 6680
  derived and/or modified CDS sequence (AUadapt) from InfluenzaA__AGB13410__HA

SEQ ID NO: 10050 - RNA, 1701 nt, Artificial Sequence; identical to SEQ ID NO: 6699
  derived and/or modified CDS sequence (AUadapt) from InfluenzaA__AGB13420__HA

SEQ ID NO: 10051 - RNA, 1701 nt, Artificial Sequence
  derived and/or modified CDS sequence (AUadapt) from InfluenzaA__AGB13430__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagauguuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccacgagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccaccaugaucuaccagauccuggccaucuacucgaccgucgcguccagccuggugcucguggucucgcugggcgccaucuccuucuggaugugcagcaacggcucccugcagugccgcaucugcaucuga

SEQ ID NO: 10052 - RNA, 1701 nt, Artificial Sequence; identical to SEQ ID NO: 7287
  derived and/or modified CDS sequence (AUadapt) from InfluenzaA__AGB13440__HA

SEQ ID NO: 10053 - RNA, 1701 nt, Artificial Sequence; identical to SEQ ID NO: 6699
  derived and/or modified CDS sequence (AUadapt) from InfluenzaA__AGB13450__HA

SEQ ID NO: 10054 - RNA, 1701 nt, Artificial Sequence; identical to SEQ ID NO: 6680
  derived and/or modified CDS sequence (AUadapt) from InfluenzaA__AGB13460__HA

SEQ ID NO: 10055 - RNA, 1701 nt, Artificial Sequence; identical to SEQ ID NO: 7112
  derived and/or modified CDS sequence (AUadapt) from InfluenzaA__AGB13470__HA

SEQ ID NO: 10056 - RNA, 1701 nt, Artificial Sequence; identical to SEQ ID NO: 6699
  derived and/or modified CDS sequence (AUadapt) from InfluenzaA__AGB13480__HA

SEQ ID NO: 10057 - RNA, 1701 nt, Artificial Sequence; identical to SEQ ID NO: 7112
  derived and/or modified CDS sequence (AUadapt) from InfluenzaA__AGB13490__HA

SEQ ID NO: 10058 - RNA, 1701 nt, Artificial Sequence
  derived and/or modified CDS sequence (AUadapt) from InfluenzaA__AGB13500__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcaacuucaucgacuacgaggagcuccgggagcagcugucguccgugucguccuucgagcgcuucgagaucuuccccaagaccagcuccuggcccgaccacgacucgaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggcgccccgguacgccuucgccauggagcgcaacgccggcucgggcaucaucaucuccgacacgcccguccacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgugccgucgauccagucccggggccuguucggggccaucgccggcuucaucgagggcggguggacgggcauggucgacgggugguacggcuaccaccaccagaacgagcaggggagcggcuacgccgcggaccucaaguccacccagaacgccaucgacaagaucaccaacaaggugaacucggugaucgagaagaugaacacccaguucacggccgucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggcgaagcugaaccgggaggagaucgacggggugaagcucgaguccacccgcaucuaccagauccuggccaucuacucgaccguggccuccagccugguccucguggugucgcugggcgccaucuccuucuggaugugcagcaacggcucccugcagugccggaucugcaucuga

SEQ ID NO: 10059 - RNA, 1701 nt, Artificial Sequence; identical to SEQ ID NO: 7317
  derived and/or modified CDS sequence (AUadapt) from InfluenzaA__AGB13520__HA

SEQ ID NO: 10060 - RNA, 1701 nt, Artificial Sequence
  derived and/or modified CDS sequence (AUadapt) from InfluenzaA__AGB13530__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucaacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 10061 - RNA, 1701 nt, Artificial Sequence; identical to SEQ ID NO: 7331
  derived and/or modified CDS sequence (AUadapt) from InfluenzaA__AGB13540__HA

SEQ ID NO: 10062 - RNA, 1701 nt, Artificial Sequence; identical to SEQ ID NO: 7295
  derived and/or modified CDS sequence (AUadapt) from InfluenzaA__AGB13550__HA

SEQ ID NO: 10063 - RNA, 1701 nt, Artificial Sequence; identical to SEQ ID NO: 7295
  derived and/or modified CDS sequence (AUadapt) from InfluenzaA__AGB13560__HA

SEQ ID NO: 10064 - RNA, 1701 nt, Artificial Sequence; identical to SEQ ID NO: 7112
  derived and/or modified CDS sequence (AUadapt) from InfluenzaA__AGB13570__HA

SEQ ID NO: 10065 - RNA, 1701 nt, Artificial Sequence
  derived and/or modified CDS sequence (AUadapt) from InfluenzaA__AGB13580__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcaacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 10066 - RNA, 1701 nt, Artificial Sequence
  derived and/or modified CDS sequence (AUadapt) from InfluenzaA__AGB13590__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 10067 - RNA, 1701 nt, Artificial Sequence
  derived and/or modified CDS sequence (AUadapt) from InfluenzaA__AGB13600__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugaacaaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 10068 - RNA, 1701 nt, Artificial Sequence; identical to SEQ ID NO: 7112
  derived and/or modified CDS sequence (AUadapt) from InfluenzaA__AGB13610__HA

SEQ ID NO: 10069 - RNA, 1701 nt, Artificial Sequence; identical to SEQ ID NO: 7331
  derived and/or modified CDS sequence (AUadapt) from InfluenzaA__AGB13620__HA

SEQ ID NO: 10070 - RNA, 1701 nt, Artificial Sequence; identical to SEQ ID NO: 6699
  derived and/or modified CDS sequence (AUadapt) from InfluenzaA__AGB13630__HA

SEQ ID NO: 10071 - RNA, 1701 nt, Artificial Sequence
  derived and/or modified CDS sequence (AUadapt) from InfluenzaA__AGB13640__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccacgagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccaccaugaucuaccagauccuggccaucuacucgaccgucgcguccagccuggugcucaucgugucgcugggcgccaucuccuucuggaugugcagcaacggcucccugcagugccgcaucugcaucuga

SEQ ID NO: 10072 - RNA, 1701 nt, Artificial Sequence
  derived and/or modified CDS sequence (AUadapt) from InfluenzaA__AGB13650__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccaccgccugcccgcacgccggcgccaaguccuucuacaagaaccugaucuggcucgugaagaaggggaacagcuaccccaagcuguccaagucguacaucaacgacaagggcaaggaggugcugguccucugggggauccaccacccgcccacgagcgcggaccagcagucccuguaccagaacgccgacgccuacguguucgugggcaccucgcgguacuccaagaaguucaagcccgagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccucgcugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacggcaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcugauccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccaccaugaucuaccagauccuggccaucuacucgaccguggcguccagccugguccucaucgugucgcugggcgccaucuccuucuggaugugcagcaacggcucccugcagugccgcaucugcaucuga

SEQ ID NO: 10073 - RNA, 1701 nt, Artificial Sequence; identical to SEQ ID NO: 7069
  derived and/or modified CDS sequence (AUadapt) from InfluenzaA__AGB13660__HA

SEQ ID NO: 10074 - RNA, 1701 nt, Artificial Sequence; identical to SEQ ID NO: 6680
  derived and/or modified CDS sequence (AUadapt) from InfluenzaA__AGB13721__HA

SEQ ID NO: 10075 - RNA, 1701 nt, Artificial Sequence; identical to SEQ ID NO: 7112
  derived and/or modified CDS sequence (AUadapt) from InfluenzaA__AGB13731__HA

SEQ ID NO: 10076 - RNA, 1701 nt, Artificial Sequence; identical to SEQ ID NO: 115
  derived and/or modified CDS sequence (AUadapt) from InfluenzaA__AGB51356__HA

SEQ ID NO: 10077 - RNA, 1701 nt, Artificial Sequence
  derived and/or modified CDS sequence (AUadapt) from InfluenzaA__AGB97269__HA
augaaggccauccuggugguccuccuguacaccuucgccaccgcgaacgccgacacgcugugcaucggcuaccacgccaacaacucgaccgacaccguggacaccgugcucgagaagaacaucacggucacccacuccgugaaccugcuggaggacaagcacaacgggaagcucugcaagcugcgcggcguggcgccccugcaccucgggaagugcaacaucgccggcuggauccuggggaacccggagugcgagacccugucgaccgccuccucgugguccuacaucgucgagacgagcuccucggacaacgggaccugcuaccccggcgacuucaucgacuacgaggagcuccgggagcagcuguccucgguguccagcuucgagcgcuucgagaucuuccccaagaccuccucguggcccaaccacgacuccaacaagggcgugaccgccgccugcccgcacgccggcgcgaagggguucuacaagaaccugaucuggcucgucaagaagggcaacucguaccccaagcuguccaagagcuacaucaacgacaaggggaaggaggugcuggugcucuggggcauccaccaccccuccacgaccgccgaccagcagucgcuguaccagaacgccgacaccuacgucuucgugggcaccucgcgguacuccaagaaguucaagcccgagaucgccauccgcccgaaggugcgggaccaggaggggcgcaugaacuacuacuggacgcuggucgagcccggcgacaagaucaccuucgaggccaccgggaaccucguggugccccgguacgcguucgccauggagcgcgacgccggcucgggcaucaucaucuccgacacccccguccacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgugccgucgauccagucccggggccuguucggggcgaucgccggcuucaucgagggcggguggaccggcauggucgacgggugguacggcuaccaccaccagaacgagcaggggucgggcuacgccgccgaccucaaguccacgcagaacgccaucgacaagaucaccaacaaggugaacagcgugaucgagaagaugaacacccaguucaccgcggucggcaaggaguucaaccaccuggagaagcgcaucgagaaccugaacaagaagguggacgacggguuccucgacaucuggacguacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagucgacccgcaucuaccagauccuggccaucuacuccaccgcggccagcucccuggugcucgucgugucgcugggcgccaucuccuucuggaugugcucgaacggcagccugcagugccggaucugcaucuga

SEQ ID NO: 10078 - RNA, 1701 nt, Artificial Sequence; identical to SEQ ID NO: 8431
  derived and/or modified CDS sequence (AUadapt) from InfluenzaA__AGB97273__HA

SEQ ID NO: 10079 - RNA, 1701 nt, Artificial Sequence
  derived and/or modified CDS sequence (AUadapt) from InfluenzaA__AGB97288__HA
augaagaccaucaucgcccugggcuacauccucugccugguguucgcccagaagcugcccgggaacgacaacucgaccgcgacgcucugccugggccaccacgccgucccgaacgggaccaucgugaagaccaucaccaacgaccgcaucgaggugacgaacgccaccgagcugguccagaacuccagcaucggcgagaucugcgacucgccccaccagauccucgacgggaagaacugcacccugaucgacgcccugcucggcgacccccagugcgacggcuuccagaacaagaagugggaccuguucaucgagcggagcaaggccuacuccaacugcuaccccuacgacgugccggacuacgcgucgcugcgcucccucguggccagcuccgggacccuggaguucaacaacgagucguucaacuggacgggcgucacccagaacgggaccuccagcgccugcauccggcgcuccaacucguccuucuucagccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgaaguccucgggccgcaucaccgucuccaccaagcggagccagcaggccgugaucccgaacaucggcucgcgcccccggauccgcaacauccccucccggaucagcaucuacuggacgaucgugaagcccggggacauccugcucaucaacuccaccggcaaccugaucgccccgcgcggguacuucaagauccggucgggcaaguccagcaucaugcgcuccgacgcccccaucggcaagugcaagucggagugcaucacccccaacggguccauccccaacgacaagccguuccagaacgucaaccggaucaccuacggcgccugcccccgcuacgugaagcagagcacgcugaagcucgcgaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgccgaccugaaguccacccaggcggccaucgaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacaacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 10080 - RNA, 1701 nt, Artificial Sequence
  derived and/or modified CDS sequence (AUadapt) from InfluenzaA__AGB97292__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10081 - RNA, 1701 nt, Artificial Sequence
  derived and/or modified CDS sequence (AUadapt) from InfluenzaA__AGB97300__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgcgcaagcagcugcgggagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 10082 - RNA, 1701 nt, Artificial Sequence
  derived and/or modified CDS sequence (AUadapt) from InfluenzaA__AGE89267__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccguggaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgagaaguccuucuacaagaaccugaucuggcucgucaagaaggggaacucguaccccaagcugaacaaguccuacaucaacgacaagggcaaggaggugcuggugcucugggggauccaccaccccagcaccucgacggaccagcagucccuguaccagaacgcggacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggccacgggcaaccucguggugccccgguacgccuucgcgauggagcgcaacgccgggagcggcaucaucaucuccgacacccccauccacgacugcaacacgaccugccagaccccgaagggcgccaucaacaccucgcugcccuuccagaacauccaccccaucaccaucgggaagugccccaaguacgucaaguccaccaagcugcggcucgccacgggccugcgcaacgugccgagcauccagucccgggggcuguucggcgccaucgcgggguucaucgagggcggcuggaccgggaugguggacggcugguacggguaccaccaccagaacgagcagggcucgggguacgccgccgaccucaaguccacccagaacgccaucgacgagaucaccaacaaggucaacagcgugaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacuccaacgucaagaaccucuacgagaaggucaagucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacucgaccguggccuccagccuggugcucgucgugucgcugggggcgaucuccuucuggaugugcagcaacggcucccugcagugccgcaucugcaucuga

SEQ ID NO: 10083 - RNA, 1701 nt, Artificial Sequence
  derived and/or modified CDS sequence (AUadapt) from InfluenzaA__AGE89277__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccguggaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugaacucgguguccucguucgagcgcuucgagaucuuccccaagaccuccagcuggcccaaccacgacuccaacaagggggugaccgccgccugcccgcacgccggcgagaaguccuucuacaagaaccugaucuggcucgucaagaaggggaacucguaccccaagcugaacaagagcuacaucaacgacaagggcaaggaggugcuggugcucugggggauccaccaccccuccaccucgacggaccagcagagccuguaccagaacgcggacgccuacgucuucgugggcaccucccgguacucgaagaaguucaagcccgagaucgccauccgcccgaaggugcgggaccaggagggccgcaugaacuacuacuggacccuggucgagcccggggacaagaucaccuucgaggccacgggcaaccucguggugccccgguacgccuucgcgauggagcgcaacgccggguccggcaucaucaucucggacacccccauccacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacccuggacuaccacgacucgaacgucaagaaccucuacgagaaggugaagucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgucaagcucgagagcacccggaucuaccagauccuggccaucuacuccaccguggccucgucccuggugcucgucgugagccugggggcgaucucguucuggaugugcuccaacggcagccugcagugccgcaucugcaucuga

SEQ ID NO: 10084 - RNA, 1701 nt, Artificial Sequence; identical to SEQ ID NO: 8601
  derived and/or modified CDS sequence (AUadapt) from InfluenzaA__AGE89287__HA

SEQ ID NO: 10085 - RNA, 1701 nt, Artificial Sequence
  derived and/or modified CDS sequence (AUadapt) from InfluenzaA__AGE89298__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccugauccucguggugucccugggcgccaucucguucuggaugugcagcaacggcucccugcagugccggaucugcaucuga

SEQ ID NO: 10086 - RNA, 1701 nt, Artificial Sequence; identical to SEQ ID NO: 7154
  derived and/or modified CDS sequence (AUadapt) from InfluenzaA__AGE89308__HA

SEQ ID NO: 10087 - RNA, 1701 nt, Artificial Sequence; identical to SEQ ID NO: 8596
  derived and/or modified CDS sequence (AUadapt) from InfluenzaA__AGE89318__HA

SEQ ID NO: 10088 - RNA, 1701 nt, Artificial Sequence
  derived and/or modified CDS sequence (AUadapt) from InfluenzaA__AGE89329__HA
augaagaccaucaucgcccugucguacauccucugccugguguucgcccagaagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10089 - RNA, 1701 nt, Artificial Sequence; identical to SEQ ID NO: 6699
  derived and/or modified CDS sequence (AUadapt) from InfluenzaA__AGE89340__HA

SEQ ID NO: 10090 - RNA, 1701 nt, Artificial Sequence; identical to SEQ ID NO: 8599
  derived and/or modified CDS sequence (AUadapt) from InfluenzaA__AGE89350__HA

SEQ ID NO: 10091 - RNA, 1701 nt, Artificial Sequence
  derived and/or modified CDS sequence (AUadapt) from InfluenzaA__AGE89361__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacgaccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 10092 - RNA, 1701 nt, Artificial Sequence; identical to SEQ ID NO: 8596
  derived and/or modified CDS sequence (AUadapt) from InfluenzaA__AGE89371__HA

SEQ ID NO: 10093 - RNA, 1701 nt, Artificial Sequence
  derived and/or modified CDS sequence (AUadapt) from InfluenzaA__AGE89382__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccuggugaagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 10094 - RNA, 1701 nt, Artificial Sequence
  derived and/or modified CDS sequence (AUadapt) from InfluenzaA__AGE89392__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10095 - RNA, 1701 nt, Artificial Sequence; identical to SEQ ID NO: 10082
  derived and/or modified CDS sequence (AUadapt) from InfluenzaA__AGE89422__HA

SEQ ID NO: 10096 - RNA, 1701 nt, Artificial Sequence; identical to SEQ ID NO: 8579
  derived and/or modified CDS sequence (AUadapt) from InfluenzaA__AGE89719__HA

SEQ ID NO: 10097 - RNA, 1701 nt, Artificial Sequence
  derived and/or modified CDS sequence (AUadapt) from InfluenzaA__AGE89730__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacggccagggguccggcuacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggguuccuggacaucuggaccuacaacgccgagcugcucgugcugcuggagaacgagcgcacccucgacuaccacgacagcaacgugaagaaccuguacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcucaaccgcgaggagaucgacggggugaagcuggagagcacccggaucuaccagauccuggcgaucuacuccaccgucgccucgagccucgugcugguggucucccugggcgccaucucguucuggaugugcuccaacggcagccuccagugccgcaucugcaucuga

SEQ ID NO: 10098 - RNA, 1701 nt, Artificial Sequence; identical to SEQ ID NO: 8596
  derived and/or modified CDS sequence (AUadapt) from InfluenzaA__AGE89740__HA

SEQ ID NO: 10099 - RNA, 1701 nt, Artificial Sequence
  derived and/or modified CDS sequence (AUadapt) from InfluenzaA__AGE89751__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucggccggggagaucugcgacagcccccaccacauccucgacggcgagaacugcacccugaucgacgcccugcucggggacccccagugcgacggcuuccagaacaagaagugggaccuguucguggagcgcucccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccucaagagcacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggucguacaacgccgagcuccugguggcgauggagaaccagcacaccaucgaccugaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacguguaccgcgacgaggcccuguccaaccgguuccagaucaagggggucgagcucaagucgggcuacaaggacuggauccuguggaucuccuucgccaucagcugcuuccugcucugcguggcgcugcugggcuucaucaugugggccugccagaaggggaacauccgcugcaacaucugcaucuga

SEQ ID NO: 10100 - RNA, 1701 nt, Artificial Sequence; identical to SEQ ID NO: 8599
  derived and/or modified CDS sequence (AUadapt) from InfluenzaA__AGE89762__HA

SEQ ID NO: 10101 - RNA, 1701 nt, Artificial Sequence
  derived and/or modified CDS sequence (AUadapt) from InfluenzaA__AGF44891__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgguggacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 10102 - RNA, 1701 nt, Artificial Sequence; identical to SEQ ID NO: 10101
  derived and/or modified CDS sequence (AUadapt) from InfluenzaA__AGF44892__HA

SEQ ID NO: 10103 - RNA, 1701 nt, Artificial Sequence
  derived and/or modified CDS sequence (AUadapt) from InfluenzaA__AGF44895__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10104 - RNA, 1701 nt, Artificial Sequence; identical to SEQ ID NO: 10080
  derived and/or modified CDS sequence (AUadapt) from InfluenzaA__AGF44896__HA

SEQ ID NO: 10105 - RNA, 1701 nt, Artificial Sequence
  derived and/or modified CDS sequence (AUadapt) from InfluenzaA__AGF44897__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcaugcgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccagucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 10106 - RNA, 1701 nt, Artificial Sequence; identical to SEQ ID NO: 10103
  derived and/or modified CDS sequence (AUadapt) from InfluenzaA__AGF44900__HA

SEQ ID NO: 10107 - RNA, 1701 nt, Artificial Sequence; identical to SEQ ID NO: 10103
  derived and/or modified CDS sequence (AUadapt) from InfluenzaA__AGF44901__HA

SEQ ID NO: 10108 - RNA, 1701 nt, Artificial Sequence; identical to SEQ ID NO: 10103
  derived and/or modified CDS sequence (AUadapt) from InfluenzaA__AGF44902__HA

SEQ ID NO: 10109 - RNA, 1701 nt, Artificial Sequence; identical to SEQ ID NO: 10103
  derived and/or modified CDS sequence (AUadapt) from InfluenzaA__AGF44903__HA

SEQ ID NO: 10110 - RNA, 1701 nt, Artificial Sequence; identical to SEQ ID NO: 10103
  derived and/or modified CDS sequence (AUadapt) from InfluenzaA__AGF44904__HA

SEQ ID NO: 10111 - RNA, 1701 nt, Artificial Sequence
  derived and/or modified CDS sequence (AUadapt) from InfluenzaA__AGF44905__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaacaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10112 - RNA, 1701 nt, Artificial Sequence; identical to SEQ ID NO: 10103
  derived and/or modified CDS sequence (AUadapt) from InfluenzaA__AGF44906__HA

SEQ ID NO: 10113 - RNA, 1701 nt, Artificial Sequence
  derived and/or modified CDS sequence (AUadapt) from InfluenzaA__AGF44908__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 10114 - RNA, 1701 nt, Artificial Sequence; identical to SEQ ID NO: 10103
  derived and/or modified CDS sequence (AUadapt) from InfluenzaA__AGF44909__HA

SEQ ID NO: 10115 - RNA, 1701 nt, Artificial Sequence; identical to SEQ ID NO: 10103
  derived and/or modified CDS sequence (AUadapt) from InfluenzaA__AGF44910__HA

SEQ ID NO: 10116 - RNA, 1701 nt, Artificial Sequence
  derived and/or modified CDS sequence (AUadapt) from InfluenzaA__AGF44911__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagucgggcuacaaggacuggauccuguggaucuccuucgccaccagcugcuuccugcugugcguggcccugcucggguucaucaugugggcgugccagaagggcaacauccggugcaacaucugcaucuga

SEQ ID NO: 10117 - RNA, 1701 nt, Artificial Sequence; identical to SEQ ID NO: 10103
  derived and/or modified CDS sequence (AUadapt) from InfluenzaA__AGF44912__HA

SEQ ID NO: 10118 - RNA, 1701 nt, Artificial Sequence; identical to SEQ ID NO: 10103
  derived and/or modified CDS sequence (AUadapt) from InfluenzaA__AGF44913__HA

SEQ ID NO: 10119 - RNA, 1701 nt, Artificial Sequence
  derived and/or modified CDS sequence (AUadapt) from InfluenzaA__AGF44914__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaacaagaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 10120 - RNA, 1701 nt, Artificial Sequence; identical to SEQ ID NO: 10080
  derived and/or modified CDS sequence (AUadapt) from InfluenzaA__AGF44916__HA

SEQ ID NO: 10121 - RNA, 1701 nt, Artificial Sequence
  derived and/or modified CDS sequence (AUadapt) from InfluenzaA__AGF44917__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgagcagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccucguccggcacgcucgaguucaacaacgagagcuucaacuggaccggggugacccagaacggcaccuccucggccugcauccgcggguccgacagcuccuucuucucgcggcugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccggccgcaucaccgugagcacgaagcggucgcagcaggccgugaucccgaacaucggcucccgcccccggauccgcaacauccccagccggaucuccaucuacuggaccaucgucaagcccggggacauccugcugaucaacucgaccggcaaccucaucgccccgcgcggguacuucaagauccgguccggcaagagcuccaucaugcgcucggacgcccccaucggcaagugcaacuccgagugcaucacccccaacgggagcauccccaacgacaagccguuccagaacgugaaccggaucacguacggcgcgugcccccgcuacgugaagcagaacacccugaagcuggccaccgggaugcggaacguccccgagaagcagacccgcggcaucuucggggccaucgccggcuucaucgagaacggcugggaggggaugauggacggcugguacggguuccggcaccagaacuccgagggccgcgggcaggccgcggaccucaagucgacgcaggccgccaucgaccagaucaacggcaagcugaaccggcugaucggcaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgggagaacgcggaggacaugggcaacgggugcuucaagaucuaccacaagugcgacaacgccugcaucggcucgauccgcaacgggaccuacaaccacgacguguaccgcgacgaggcccugaacaaccgguuccagaucaagggcguggagcucaaguccggcuacaaggacuggauccuguggaucagcuucgccaucuccugcuuccugcucugcgucgcccugcugggguucaucaugugggcgugccagaagggcaacauccgcugcaacaucugcaucuga

SEQ ID NO: 10122 - RNA, 1701 nt, Artificial Sequence; identical to SEQ ID NO: 10080
  derived and/or modified CDS sequence (AUadapt) from InfluenzaA__AGF44918__HA

SEQ ID NO: 10123 - RNA, 1701 nt, Artificial Sequence
  derived and/or modified CDS sequence (AUadapt) from InfluenzaA__AGF44919__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacuacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10124 - RNA, 1701 nt, Artificial Sequence; identical to SEQ ID NO: 10080
  derived and/or modified CDS sequence (AUadapt) from InfluenzaA__AGF44920__HA

SEQ ID NO: 10125 - RNA, 1701 nt, Artificial Sequence; identical to SEQ ID NO: 10103
  derived and/or modified CDS sequence (AUadapt) from InfluenzaA__AGF44921__HA

SEQ ID NO: 10126 - RNA, 1701 nt, Artificial Sequence
  derived and/or modified CDS sequence (AUadapt) from InfluenzaA__AGG13411__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcggucgaaggcccacuccaacugcuaccccuacgacgugccggacuacgcgagccugcgcucccucgucgccucguccggcacgcuggaguucaacaacgagucguucaacuggaccggggugacccagaacggcaccuccagcgccugcauccggcgcuccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcgcaucaccguguccacgaagcggaaccagcagaccgugaucccgaacaucggcagccgcccccggguccgcaacauccccucgcggguguccaucuacuggaccaucgugaagcccggcgacauccugcucaucaacucgaccgggaaccugaucgccccgcgcggcuacuucaagauccgguccgggaaguccuccaucaugcgcagcgacgcccccaucggcaagugcaacuccgccugcaucacgcccaacggcucgauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacuccgaggggcgcggccaggccgcggaccucaagucgacccaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccggaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggcgugccagaaggggaacauccgcugcaacaucugcaucuga

SEQ ID NO: 10127 - RNA, 1701 nt, Artificial Sequence
  derived and/or modified CDS sequence (AUadapt) from InfluenzaA__AGG13447__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcggucgaaggcccacuccaacugcuaccccuacgacgugccggacuacgcgagccugcgcucccucgucgccucguccggcacgcuggaguucaacaacgagagcuucaacuggaccggggugacccagaacggcaccuccucggccugcauccggcgcuccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcagaccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagacccagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggcgugccagaaggggaacauccgcugcaacaucugcaucuga

SEQ ID NO: 10128 - RNA, 1701 nt, Artificial Sequence
  derived and/or modified CDS sequence (AUadapt) from InfluenzaA__AGG13459__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10129 - RNA, 1701 nt, Artificial Sequence
  derived and/or modified CDS sequence (AUadapt) from InfluenzaA__AGG13495__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccgacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaguccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgggagaacgccgaggacauggggaacggcugcuucaagaucuaccacaagugcgacaacgcgugcaucggguccauccgcaacggcaccuacaaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 10130 - RNA, 1701 nt, Artificial Sequence; identical to SEQ ID NO: 10128
  derived and/or modified CDS sequence (AUadapt) from InfluenzaA__AGG13507__HA

SEQ ID NO: 10131 - RNA, 1701 nt, Artificial Sequence
  derived and/or modified CDS sequence (AUadapt) from InfluenzaA__AGG13519__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccgacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaguccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcguccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgggagaacgccgaggacauggggaacggcugcuucaagaucuaccacaagugcgacaacgcgugcaucggguccauccgcaacggcaccuacaaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 10132 - RNA, 1701 nt, Artificial Sequence; identical to SEQ ID NO: 10128
  derived and/or modified CDS sequence (AUadapt) from InfluenzaA__AGG13531__HA

SEQ ID NO: 10133 - RNA, 1701 nt, Artificial Sequence
  derived and/or modified CDS sequence (AUadapt) from InfluenzaA__AGG13543__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggacaucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10134 - RNA, 1701 nt, Artificial Sequence; identical to SEQ ID NO: 10128
  derived and/or modified CDS sequence (AUadapt) from InfluenzaA__AGG13555__HA

SEQ ID NO: 10135 - RNA, 1701 nt, Artificial Sequence; identical to SEQ ID NO: 10128
  derived and/or modified CDS sequence (AUadapt) from InfluenzaA__AGG13567__HA

SEQ ID NO: 10136 - RNA, 1701 nt, Artificial Sequence
  derived and/or modified CDS sequence (AUadapt) from InfluenzaA__AGG13591__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgagaacuucaacuggacgggggugacccagaacggcaccuccucggccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgaccggccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 10137 - RNA, 1701 nt, Artificial Sequence
  derived and/or modified CDS sequence (AUadapt) from InfluenzaA__AGG13615__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagucguccgggcgcaucaccgugagcaccaagcggucgcagcaggccgugaucccgaacaucggcucccgcccccggauccgcaacauccccagccggaucuccaucuacuggacgaucgucaagcccggcgacauccugcugaucaacucgaccgggaaccucaucgccccgcgcggcuacuucaagauccgguccggcaagagcuccaucaugcgcagcgacgcccccaucgggaagugcaaguccgagugcaucacccccaacggcucgauccccuccgacaagccguuccagaacgugaaccggaucaccuacggggccugcccccgcuacgugaagcagagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacgacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 10138 - RNA, 1701 nt, Artificial Sequence; identical to SEQ ID NO: 10136
  derived and/or modified CDS sequence (AUadapt) from InfluenzaA__AGG13627__HA

SEQ ID NO: 10139 - RNA, 1701 nt, Artificial Sequence
  derived and/or modified CDS sequence (AUadapt) from InfluenzaA__AGG13639__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacgaacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10140 - RNA, 1701 nt, Artificial Sequence; identical to SEQ ID NO: 10129
  derived and/or modified CDS sequence (AUadapt) from InfluenzaA__AGG13651__HA

SEQ ID NO: 10141 - RNA, 1701 nt, Artificial Sequence; identical to SEQ ID NO: 10128
  derived and/or modified CDS sequence (AUadapt) from InfluenzaA__AGG13663__HA

SEQ ID NO: 10142 - RNA, 1701 nt, Artificial Sequence; identical to SEQ ID NO: 10129
  derived and/or modified CDS sequence (AUadapt) from InfluenzaA__AGG13675__HA

SEQ ID NO: 10143 - RNA, 1701 nt, Artificial Sequence; identical to SEQ ID NO: 10128
  derived and/or modified CDS sequence (AUadapt) from InfluenzaA__AGG13687__HA

SEQ ID NO: 10144 - RNA, 1701 nt, Artificial Sequence; identical to SEQ ID NO: 10129
  derived and/or modified CDS sequence (AUadapt) from InfluenzaA__AGG13711__HA

SEQ ID NO: 10145 - RNA, 1701 nt, Artificial Sequence; identical to SEQ ID NO: 10128
  derived and/or modified CDS sequence (AUadapt) from InfluenzaA__AGG13723__HA

SEQ ID NO: 10146 - RNA, 1701 nt, Artificial Sequence; identical to SEQ ID NO: 10128
  derived and/or modified CDS sequence (AUadapt) from InfluenzaA__AGG13735__HA

SEQ ID NO: 10147 - RNA, 1701 nt, Artificial Sequence; identical to SEQ ID NO: 10128
  derived and/or modified CDS sequence (AUadapt) from InfluenzaA__AGG13747__HA

SEQ ID NO: 10148 - RNA, 1701 nt, Artificial Sequence
  derived and/or modified CDS sequence (AUadapt) from InfluenzaA__AGG13759__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcggucgaaggcccacuccaacugcuaccccuacgacgugccggacuacgcgagccugcgcucccucgucgccucguccggcacgcuggaguucaacaacgagagcuucaacuggaccggggugacccagaacggcaccuccucggccugcauccggcgcuccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcagaccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggcgugccagaaggggaacauccgcugcaacaucugcaucuga

SEQ ID NO: 10149 - RNA, 1701 nt, Artificial Sequence
  derived and/or modified CDS sequence (AUadapt) from InfluenzaA__AGG13771__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccgacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaguccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccagagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaacaagaucgaccugugguccuacaacgccgagcuccugguggcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacaaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 10150 - RNA, 1701 nt, Artificial Sequence
  derived and/or modified CDS sequence (AUadapt) from InfluenzaA__AGG13783__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaugggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacguccccagccggaucuccaucuacuggaccaucgugaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgucaagcaguccacccugaagcucgccacggggaugcggaacgugcccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 10151 - RNA, 1701 nt, Artificial Sequence; identical to SEQ ID NO: 10129
  derived and/or modified CDS sequence (AUadapt) from InfluenzaA__AGG13795__HA

SEQ ID NO: 10152 - RNA, 1701 nt, Artificial Sequence; identical to SEQ ID NO: 10080
  derived and/or modified CDS sequence (AUadapt) from InfluenzaA__AGG13807__HA

SEQ ID NO: 10153 - RNA, 1701 nt, Artificial Sequence; identical to SEQ ID NO: 10129
  derived and/or modified CDS sequence (AUadapt) from InfluenzaA__AGG13819__HA

SEQ ID NO: 10154 - RNA, 1701 nt, Artificial Sequence; identical to SEQ ID NO: 10129
  derived and/or modified CDS sequence (AUadapt) from InfluenzaA__AGG13831__HA

SEQ ID NO: 10155 - RNA, 1701 nt, Artificial Sequence; identical to SEQ ID NO: 10128
  derived and/or modified CDS sequence (AUadapt) from InfluenzaA__AGG13855__HA

SEQ ID NO: 10156 - RNA, 1701 nt, Artificial Sequence
  derived and/or modified CDS sequence (AUadapt) from InfluenzaA__AGG13867__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucgggaagaucugcgacucgccccaccagauccucgacggcgagaacugcacccugauggacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10157 - RNA, 1701 nt, Artificial Sequence; identical to SEQ ID NO: 10128
  derived and/or modified CDS sequence (AUadapt) from InfluenzaA__AGG13879__HA

SEQ ID NO: 10158 - RNA, 1701 nt, Artificial Sequence; identical to SEQ ID NO: 10128
  derived and/or modified CDS sequence (AUadapt) from InfluenzaA__AGG13891__HA

SEQ ID NO: 10159 - RNA, 1701 nt, Artificial Sequence
  derived and/or modified CDS sequence (AUadapt) from InfluenzaA__AGG13903__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccgacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaguccgugcugccgaacaucggcagccggccccgcauccggaacauccccucccgcaucucgaucuacuggaccaucgucaagcccggcgacauccuccugaucaacuccaccgggaaccugaucgccccgcggggcuacuucaagauccagagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagaacacccucaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagaagaccaagaagcagcuccgggagaacgccgaggacauggggaacggcugcuucaagaucuaccacaagugcgacaacgcgugcaucggguccauccgcaacggcaccuacaaccacgacguguaccgcgacgaggcccugaacaaccgguuccagaucaagggggucgagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 10160 - RNA, 1701 nt, Artificial Sequence; identical to SEQ ID NO: 10128
  derived and/or modified CDS sequence (AUadapt) from InfluenzaA__AGG13927__HA

SEQ ID NO: 10161 - RNA, 1701 nt, Artificial Sequence; identical to SEQ ID NO: 10136
  derived and/or modified CDS sequence (AUadapt) from InfluenzaA__AGG13939__HA

SEQ ID NO: 10162 - RNA, 1701 nt, Artificial Sequence
  derived and/or modified CDS sequence (AUadapt) from InfluenzaA__AGG13962__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagggguucgagaucuuccccaagaccagcuccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccccagcaccacggccgaccagcagucccuguaccagaacgccgacgccuacguguucgugggcaccucgcgcuacuccaagaaguucaagcccgagaucgccauccggccgaagguccgcgaccaggaggggcggaugaacuacuacuggacccugaucgagcccggcgacaagaucaccuucgaggcgacggggaaccucguggugccccgcuacgccuucgccauggagcggaacgccgagucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 10163 - RNA, 1701 nt, Artificial Sequence; identical to SEQ ID NO: 10128
  derived and/or modified CDS sequence (AUadapt) from InfluenzaA__AGG13973__HA

SEQ ID NO: 10164 - RNA, 1701 nt, Artificial Sequence; identical to SEQ ID NO: 10128
  derived and/or modified CDS sequence (AUadapt) from InfluenzaA__AGG13985__HA

SEQ ID NO: 10165 - RNA, 1701 nt, Artificial Sequence; identical to SEQ ID NO: 10128
  derived and/or modified CDS sequence (AUadapt) from InfluenzaA__AGG13997__HA

SEQ ID NO: 10166 - RNA, 1701 nt, Artificial Sequence; identical to SEQ ID NO: 10128
  derived and/or modified CDS sequence (AUadapt) from InfluenzaA__AGG14009__HA

SEQ ID NO: 10167 - RNA, 1701 nt, Artificial Sequence
  derived and/or modified CDS sequence (AUadapt) from InfluenzaA__AGG14021__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggaucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 10168 - RNA, 1701 nt, Artificial Sequence; identical to SEQ ID NO: 10129
  derived and/or modified CDS sequence (AUadapt) from InfluenzaA__AGG14033__HA

SEQ ID NO: 10169 - RNA, 1701 nt, Artificial Sequence; identical to SEQ ID NO: 10148
  derived and/or modified CDS sequence (AUadapt) from InfluenzaA__AGG14318__HA

SEQ ID NO: 10170 - RNA, 1701 nt, Artificial Sequence
  derived and/or modified CDS sequence (AUadapt) from InfluenzaA__AGG14330__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucauccgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10171 - RNA, 1701 nt, Artificial Sequence
  derived and/or modified CDS sequence (AUadapt) from InfluenzaA__AGG84179__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucggccuccgagaucugcgacagcccccaccacauccucgacggggagaacugcacccugaucgacgcccugcucggcgacccccagugcgacggguuccagaacaagaagugggaccuguucguggagcgcucccgggcguacucgaacugcuaccccuacgacgugccggacuacgccucccugcgcagccucgucgccuccucgggcacccuggaguucaacaacgaguccuucaacuggacgggcgugacccagaacgggaccagcuccgccugcauccggcgcucgaacaacuccuucuucagccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccggccgcaucaccgugucgaccaagcggagccagcaggccgugaucccgaacaucgggucccgcccccggguccgcaacauccccucgcggaucuccaucuacuggacgaucgugaagcccggcgacauccugcucaucaacagcaccggcaaccugaucgccccgcgcggguacuucaagauccgguccggcaagucguccaucaugcgcagcgacgcgcccaucgggaagugcaacuccgagugcaucacccccaacggcucgauccccaacgacaagccguuccagaacgugaaccggaucaccuacggcgccugcccccgcuacgucaagcaguccacgcugaagcucgccaccgggaugcggaacgugcccgagaagcagacccgcggcaucuucggggccaucgccggcuucaucgagaacgggugggagggcaugauggacggcugguacggguuccggcaccagaacagcgagggccgcgggcaggcggccgaccugaaguccacccaggccgccaucgaccagaucaacggcaagcugaaccggcucaucgggaagacgaacgagaaguuccaccagaucgagaaggaguucucggagguggagggccgcauccaggaccuggagaaguacgucgaggacaccaagaucgaccugugguccuacaacgccgagcuccugguggcgcuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagucgggguacaaggacuggauccuguggaucuccuucgccaucagcugcuuccugcugugcguggcgcugcucggcuucaucaugugggccugccagaagggcaacauccgcugcaacaucugcaucuga

SEQ ID NO: 10172 - RNA, 1704 nt, Artificial Sequence
  derived and/or modified CDS sequence (AUadapt) from InfluenzaA__AGI02564__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccgggaacuucaacgacuacgaggagcugaagcaccuccugucccggaucaaccacuucgagaagauccagaucauccccaagucguccuggagcggccacgaggccuccucgggcgucuccagcgccugcccguaccaggggacgcccuccuucuuccgcaacgugguguggcugaucaagaagaacaacaccuaccccaccaucaagcggucguacaacaacaccaaccaggaggaccuccugauccuguggggcauccaccacuccaacgacgcggccgagcagacgaagcucuaccagaacccgaccaccuacaucagcgucgggaccuccacgcugaaccagcgccuggugcccaagaucgccacccggucgaaggugaacggccaguccgggcgcauggacuucuucuggaccauccucaagcccaacgacgccaucaacuucgagagcaacggcaacuucaucgcgcccgaguacgccuacaagaucgucaagaagggcgacucggccaucaugaaguccgagguggaguacgggaacugcaacaccaagugccagacgccgaucggcgccaucaacagcuccaugcccuuccacaacauccacccccugaccaucggggagugccccaaguacgucaagucgaacaagcuggugcucgccaccggccugcggaacuccccgcugcgcgagcggcgccggaagcgcggccucuucggggcgaucgccggcuucaucgagggcggguggcaggggaugguggacggcugguacggcuaccaccacagcaacgagcagggguccggcuacgccgccgacaaggagucgacccagaaggccaucgacggggugacgaacaaggucaacuccaucaucgacaagaugaacacccaguucgaggcggugggccgggaguucaacaaccuggagcgccggaucgagaaccugaacaagaagauggaggacggguuccucgacguguggaccuacaacgccgagcugcugguccucauggagaacgagcgcacccuggacuuccacgacagcaacgugaagaaccuguacgacaagguccggcuccagcugcgcaacaacgccaaggagcugggcaacggcugcuucgaguucuaccacaagugcgacaacgagugcauggaguccgugcggaacgggacguacgacuacccccaguacucggaggaggcccgccucaagcgggaggagaucuccggcgugaagcuggagagcaucgggaccuaccagauccuguccaucuacucgaccgucgccuccagccucgcgcuggccaucaugguggccggccugucccucuggaugugcucgaacgggagccugcagugccgcaucugcaucuga

SEQ ID NO: 10173 - RNA, 1707 nt, Artificial Sequence
  derived and/or modified CDS sequence (AUadapt) from InfluenzaA__AGI02565__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccauccccgccaacgaccugugcuaccccggggacuucaacgacuacgaggagcugaagcaccuccugucccggaucaaccacuucgagaagauccagaucauccccaagagcuccuggucgaaccacgaggccucccugggcgucagcuccgcgugcccguaccucggcaagcccucguucuuccgcaacgugguguggcugaucaagaagaacuccaccuaccccacgaucaagcggagcuacaacaacaccaaccaggaggaccugcucguccugugggggauccaccacccgaacgacgccgccgagcagaccaagcuguaccagaaccccaccacguacaucuccgugggcaccucgacccucaaccagcgccuggugcccaagaucgccacccgguccaaggucaacgggcagagcggccgcauggaguucuucuggacgauccugaagcccaacgacgcgaucaacuucgaguccaacgggaacuucaucgccccggaguacgccuacaagaucgugaagaagggcgacagcgccaucaugaaguccgagcucgaguacggcaacugcaacaccaagugccagacccccaugggggccaucaacucgagcaugcccuuccacaacauccacccccugaccaucggcgagugcccgaaguacgugaaguccaaccggcugguccucgcgacggggcugcgcaacucgccccagggcgagcggcgccggaagaagcgcggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacucgaucaucgacaagaugaacacccaguucgaggccgugggccgggaguucaacaaccucgagcgccggaucgagaaccugaacaagaagauggaggacggguuccuggacguguggacguacaacgccgagcuccugguccugauggagaacgagcgcacccucgacuuccacgacuccaacgugaagaaccuguacgacaagguccggcugcagcuccgcgacaacgccaaggagcugggcaacggcugcuucgaguucuaccacaagugcgacaacgagugcauggagagcgugcggaacgggaccuacgacuacccccaguacuccgaggaggcccgccugaagcgggaggagaucucgggcgugaagcucgaguccaucgggaccuaccagauccugagcaucuacuccacggucgcgucgucccuggcccucgccaucaugguggccggccugagccuguggaugugcuccaacgggagccuccagugccgcaucugcaucuga

SEQ ID NO: 10174 - RNA, 1704 nt, Artificial Sequence
  derived and/or modified CDS sequence (AUadapt) from InfluenzaA__AGI02566__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccgccgagcagaucaagcucuaccagaacccgaccacguacaucucggucggcaccuccacccugaaccagcgccuggugcccaagaucgccacccggagcaaggugaacgggcaguccggccgcauggacuucuucuggacgauccucaagcccaacgacgcgaucaacuucgagucgaacgggaacuucaucgcccccgaguacgccuacaagaucgucaaggagggcgacagcgccaucaugaaguccgagguggaguacggcaacugcaacaccaagugccagaccccgaucggggccaucaacucguccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacucgaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagucgaucggcaccuaccagauccuguccaucuacagcacggucgcguccucgcucgcccuggccaucaugguggccgggcugucccucuggaugugcagcaacggcagccugcagugccgcaucugcaucuga

SEQ ID NO: 10175 - RNA, 1707 nt, Artificial Sequence
  derived and/or modified CDS sequence (AUadapt) from InfluenzaA__AGI02567__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaaggccaaccccgccaacgaccugugcuaccccgggaacuucaacgacuacgaggagcucaagcaccuccugucccggaucaaccacuucgagaagauccagaucauccccaagucguccuggagcgaccacgaggccuccucgggcgucuccagcgcgugcccguaccagggccgcuccucguucuuccggaacgugguguggcugaucaagaagaacaacgccuaccccaccaucaagcgcuccuacaacaacacgaaccaggaggaccugcugguccucugggggauccaccaccccaacgacgccgccgagcagacccggcuguaccagaacccgaccaccuacaucucggugggcacguccacccugaaccagcgccucgugcccaagaucgcgacccggagcaaggucaacgggcaguccggccgcauggaguucuucuggaccauccugaagcccaacgacgccaucaacuucgagucgaacgggaacuucaucgcccccgaguacgccuacaagaucgugaagaagggcgacagcacgaucaugaaguccgagcuggaguacggcaacugcaacaccaagugccagaccccgaucggggccaucaacucguccaugcccuuccacaacauccacccccucaccaucggcgagugccccaaguacgucaagagcaaccggcuggugcuggcgacggggcuccgcaacuccccgcagggcgagcggcgccggaagaagcgcggccuguucggggccaucgccggcuucaucgagggcggguggcaggggaugguggacggcugguacggcuaccaccacucgaacgagcagggguccggcuacgccgccgacaaggagucgacccagaaggcgaucgacggggugaccaacaaggucaacuccaucaucgacaagaugaacacccaguucgaggccgugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacucggaggaggcccgccugaagcgggaggagaucuccggcgugaagcuggagagcaucgggaccuaccagauccucuccaucuacucgacggucgcguccagccuggcccuggccaucaugguggccggccucucccuguggaugugcucgaacgggagccugcagugccgcaucugcaucuga

SEQ ID NO: 10176 - RNA, 1704 nt, Artificial Sequence
  derived and/or modified CDS sequence (AUadapt) from InfluenzaA__AGI02568__HA
auggagaagaucgugcugcuccuggccaucgucucgcuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccggaucaaccacuucgagaagauccagaucauccccaagagcuccuggucggaccacgaggccuccagcggcgucuccucggcgugcccguaccagggcacccccuccuucuuccgcaacgugguguggcugaucaagaagaacaacacguaccccaccaucaagcggagcuacaacaacaccaaccaggagaaccuccugauccugugggggauccaccacuccaacgacgccaccgagcagaucaagcucuaccagaacccgacgaccuacaucagcgucggcaccuccacccugaaccagcgccuggugcccaagaucgggacgcggucgaaggugaacggccaguccgggcgcauggacuucuucuggaccauccucaagcccaacgacgccaucaacuucgagagcaacggcaacuucaucgcccccgaguacgcguacaagaucgucaaggagggcgacucggccaucaugaaguccgagguggaguacgggaacugcaacaccaagugccagaccccgaucggcgccaucaacagcuccaugcccuuccacaacauccacccccugacgaucggggagugccccaaguacgucaagucgaacaagcuggugcucgccaccggccugcggaacuccccgcugcgcgagcggcgccggaagcgcggccucuucggggccaucgcgggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacgcaguucgaggccgugggccgggaguucaacaaccuggagcgccggaucgagaaccugaacaagaagauggaggacggguuccucgacguguggaccuacaacgcggagcugcugguccucauggagaacgagcgcacccuggacuuccacgacucgaacgugaagaaccuguacgacaagguccggcuccagcugcgcgacaacgccaaggagcugggcaacggcugcuucgaguucuaccacaagugcgacaacgagugcauggaguccgugcggaacgggaccuacgacuacccccaguacagcgaggaggcccgccucaagcgggaggagaucuccggcgugaagcuggagucgauggggaucuaccagauccuguccaucuacagcacggucgccuccucgcucgcccuggcgaucaugguggccggccugucccucuggaugugcagcaacgggagccugcagugccgcaucugcaucuga

SEQ ID NO: 10177 - RNA, 1683 nt, Artificial Sequence
  derived and/or modified CDS sequence (AUadapt) from InfluenzaA__AGI60301__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggagggguccgacgugugcuaccccggcaaguucgugaacgaggaagcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggauaacgcggccuucccgcagaugaccaaguccuacaagaacacccgcaagagccccgcccucaucgucuggggcauccaccacuccgugagcaccgccgagcagacgaagcuguauggguccggcaacaagcuggugaccgucggcagcuccaacuaccagcagagcuucgugcccucccccggggcccggccccaggugaacggcaucagcgggcggaucgacuuucacuggcucaugcugaaccccaacgacaccgucaccuucagcuucaacggcgcguuuaucgcccccgaccgcgccuccuuccugcggggcaaaagcauggggauccaguccggcguccagguggacgccaacugcgagggggacugcuaccauagcggcgggacgaucaucuccaaccuccccuuccagaacaucgacagccgcgccgugggcaagugcccgcgguacgugaagcagcgcucccugcugcucgcgaccgggaugaagaaugugcccgagauccccaagggccggggccuguucggggccaucgccggcuucaucgagaacgggugggagggccugaucgacgggugguacggcuuccgccaccagaacgcccagggcgaggggaccgccgcggacuauaagagcacccaauccgccaucgaccagaucacgggcaagcucaaccggcugaucgagaagaccaaccagcaguucgagcugaucgacaacgaguucaaugaggucgagaagcagaucgggaacgugaucaacuggacccgcgacagcaucaccgaggugugguccuacaacgccgagcuccuggucgccauggagaaccagcacacgaucgaccuggccgauagcgagauggacaaacucuacgagcgcgugaagcggcagcugcgcgagaacgcggaggaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcuguccagcggguacaaggacgugauccucugguucuccuuuggcgccagcugcuucauccugcuggcgaucgugauggggcucgucuucaucugcgugaagaacggcaacaugcgcugcaccaucugcaucuga

SEQ ID NO: 10178 - RNA, 1683 nt, Artificial Sequence
  derived and/or modified CDS sequence (AUadapt) from InfluenzaA__AGJ72861__HA
augaauacccaaauccugguguucgcccucaucgccaucauccccaccaacgcggacaagaucugccugggccaccacgccgucaguaacgggacgaaggugaacacccugaccgagcgcggcggggagguggucaacgccaccgagacgguggagcggaccaacaucccgcgcaucugcuccaagggcaagaagaccguggaccucgggcagggcggcccccgggggaccaucacgggcccgccccagugugaccaguuccuggaguucagcgccgaccugaucauggagcgccgggagggguccgacgucuguuaccccggcaaguucgugaacgaggaggcccuccgccagauccugcgggagagcgggggcaucgacaaggaggcgaugggcuucaccuauuccgggauccgcaccaacggcgccaccagcgccugccggcgcuccgggagcuccuucuacgccgagaugaaguggcugcucaguaacacggacaacgcggccuucccccagaugaccaaguccuacaagaacacccgcaagagccccgcccugaucguguggggcauccaucacuccgucagcaccgccgagcaaacgaagcuguacggcuccgggaacaagcucgugaccgugggcagcuccaacuaucagcagagcuucguccccuccccgggggcccggccccaggugaacggccagagcgggcggaucgacuuccauuggcugaugcugaaccccaacgacaccgugaccuucagcuucaauggcgcguucaucgcccccgaccgcgccuccuuccuccggggcaagagcauggggauccaguccggcguccagguggacgccaacugugagggggacugcuaccacagcggcgggacgaucaucuccaaccugccguuccagaauaucgacagccgcgccgugggcaagugcccccgguacgucaagcagcgcucccugcuccuggcgaccggcaugaagaacgugcccgagauccccaaggggcggggccuguucggggccaucgccggcuuuaucgagaacgggugggagggccucaucgacggcugguacggguuccgccaccagaacgcccagggcgaggggaccgccgcggauuacaagagcacccaguccgccaucgaccagaucacgggcaagcugaaccggcugaucgagaagaccaaccagcaauucgagcucaucgauaacgaguucaacgagguggagaagcagaucggcaacgucaucaacuggacccgcgacaguaucaccgaggugugguccuacaacgccgagcugcugguggccauggagaaccagcacacgaucgaccucgccgacagcgagauggauaagcuguacgagcgcgucaagcggcagcugcgcgagaacgcggaggaggacgggaccggcugcuucgagaucuuccauaagugcgacgacgacugcauggccuccauccggaacaauaccuacgaccacagcaaguaccgcgaggaggccaugcagaaccggauccagaucgauccggugaagcucuccagcggguacaaggacgucauccugugguucuccuucggcgccagcuguuucauccugcucgcgaucgugauggggcugguguucaucugcgucaagaacggcaacaugcgcugcaccaucugcaucuga

SEQ ID NO: 10179 - RNA, 1701 nt, Artificial Sequence
  derived and/or modified CDS sequence (AUadapt) from InfluenzaA__AGJ73327__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccaccagucccuguaccagaacgccgacgccuacguguucgugggcaccagccgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucauccccgacaccccgguccacgacugcaacacgaccugccagacccccaagggcgccaucaacaccucccugcccuuccagaacauccaccccaucaccaucgggaagugcccgaaguacgucaagucgaccaagcugcggcucgcgacgggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgugaucgagaagaugaacacgcaguucaccgccgucggcaaggaguucaaccaccuggagaagcgcaucgagaaccugaacaagaagcucgacgacggcuuccuggacaucuggaccuacaacgccgagcugcucgugcugcuggagaacgagcggacccucgacuaccacgacagcaacgucaagaaccuguacgagaaggugcgcaaccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggagaagaucgacggcgucaagcuggaguccacccgcaucuaccagauccuggcgaucuacucgaccguggccuccagccucgugcuggucgugucccugggggagaucucguucuggaugugcagcaacggcucccuccagugccggaucugcaucuga

SEQ ID NO: 10180 - RNA, 1701 nt, Artificial Sequence
  derived and/or modified CDS sequence (AUadapt) from InfluenzaA__AGJ73329__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacgcccccgugcacgacugcaacacgaccugccagaccccgaagggggccaucaacaccucccugcccuuccagaacauccaccccaucaccaucggcaagugccccaaguacgucaagucgaccaagcugcggcucgcgacggggcugcgcaacgugccguccauccagagccggggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacucgaccgucgccuccagccuggugcucguggucucccugggcgccaucucguucuggaugugcagcaacggcucccugcagugccggaucugcaucuga

SEQ ID NO: 10181 - RNA, 1701 nt, Artificial Sequence
  derived and/or modified CDS sequence (AUadapt) from InfluenzaA__AGJ73331__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccaccgccugcccgcacgccggcgccaaguccuucuacaagaaccugaucuggcucgugaagaaggggaacucguaccccaagcuguccaagagcuacaucaacgacaagggcaaggaggugcugguccucugggggauccaccacccgcccacgucggcggaccagcagucccuguaccagaacgccgacgccuacguguucgugggcaccucgcgguacuccaagaaguucaagcccgagaucgccauccgccccaagguccggggccaggaggggcgcaugaacuacuacuggacccugguggagcccggcgacaagaucaccuucgaggccacggggaaccucguggucccccgguacgcguucgccauggagcgcaacgccggcagcggcaucaucaucuccgacaccccggugcacgacugcaacacgaccugccagacccccaagggggccaucaacaccucgcugcccuuccagaacauccaccccaucaccaucggcaagugcccgaaguacgugaaguccaccaagcugcggcucgccacggggcugcgcaacguccccagcauccagucccggggccuguucggggcgaucgccggcuucaucgagggcggguggaccggcaugguggacgggugguacggcuaccaccaccagaacgagcaggggucgggcuacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaaggugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacucgaccgucgcguccagccuggugcucguggucucgcugggcgccaucuccuucuggaugugcagcaacggcucccugcagugccggaucugcaucuga

SEQ ID NO: 10182 - RNA, 1701 nt, Artificial Sequence
  derived and/or modified CDS sequence (AUadapt) from InfluenzaA__AGJ73333__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacacguacguguucgugggcaccucgcgguacuccaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcucgggcaucaucaucuccgacacccccgugcacgacugcaacacgaccugccagaccccgaagggggccaucaacaccagccugcccuuccagaacauccaccccaucaccaucggcaagugccccaaguacgugaaguccaccaagcugcggcucgccacggggcugcgcaacgucccgucgauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucaccaacaaggugaacucggucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgcgucgucccuggugcucguggucagccugggcgccaucucguucuggaugugcuccaacggcagccugcagugccggaucugcaucuga

SEQ ID NO: 10183 - RNA, 1701 nt, Artificial Sequence
  derived and/or modified CDS sequence (AUadapt) from InfluenzaA__AGJ73335__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagccccgggacaagaucacguucgaggccaccgggaaccucguggucccccgcuacgcguucgccauggagcggaacgccggcucggggaucaucaucuccgacacccccgugcacgacugcaacaccacgugccagaccccgaagggcgccaucaacaccagccugcccuuccagaacauccaccccaucaccaucggcaagugccccaaguacgugaaguccacgaagcugcgccucgccaccgggcugcggaacgucccgucgauccagucccgcggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacucggucaucgagaagaugaacacccaguucaccgcgguggggaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggccaucuacuccaccgucgcgucgucccuggugcucguggucagccugggcgccaucucguucuggaugugcuccaacgggagccugcagugccgcaucugcaucuga

SEQ ID NO: 10184 - RNA, 1701 nt, Artificial Sequence; identical to SEQ ID NO: 6699
  derived and/or modified CDS sequence (AUadapt) from InfluenzaA__AGJ73337__HA

SEQ ID NO: 10185 - RNA, 1701 nt, Artificial Sequence; identical to SEQ ID NO: 6699
  derived and/or modified CDS sequence (AUadapt) from InfluenzaA__AGJ73339__HA

SEQ ID NO: 10186 - RNA, 1701 nt, Artificial Sequence; identical to SEQ ID NO: 6699
  derived and/or modified CDS sequence (AUadapt) from InfluenzaA__AGJ73341__HA

SEQ ID NO: 10187 - RNA, 1701 nt, Artificial Sequence
  derived and/or modified CDS sequence (AUadapt) from InfluenzaA__AGJ73343__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcagaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 10188 - RNA, 1701 nt, Artificial Sequence
  derived and/or modified CDS sequence (AUadapt) from InfluenzaA__AGJ73345__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgaggacgccuacguguucgugggcacguccaaguacucgaagaaguucaagcccgagaucgccguccggccgaaggugcgcgaccaggagggccggaugaacuacuacuggacccugguggagcccgggaacaagaucaccuucgaggccaccggcaaccuccuggucccccgcuacgcguucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggccaccggccugcggaacgugccguccauccagagccgcgggcuguucggcgcgaucgccggguucaucgagggcggcuggacggggaugguggacggcugguacggguaccaccaccagaacgagcagggcuccggguacgccgccgaccucaagucgacccagaacgccaucgacaagaucaccaacaaggugaacuccgucaucgagaagaugaacacccaguucacggcggugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggccaucuacuccaccgucgcgucgagccucgugcugguggucucccugggggccaucucguucuggaugugcuccaacggcagccuccagugccgcaucugcaucuga

SEQ ID NO: 10189 - RNA, 1701 nt, Artificial Sequence; identical to SEQ ID NO: 7295
  derived and/or modified CDS sequence (AUadapt) from InfluenzaA__AGJ73347__HA

SEQ ID NO: 10190 - RNA, 1701 nt, Artificial Sequence; identical to SEQ ID NO: 7295
  derived and/or modified CDS sequence (AUadapt) from InfluenzaA__AGJ73349__HA

SEQ ID NO: 10191 - RNA, 1701 nt, Artificial Sequence
  derived and/or modified CDS sequence (AUadapt) from InfluenzaA__AGJ73351__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagaugcgggaccaggaggggcgcaugaacuacuacuggacccuggucgagcccggcgacaagaucacguucgaggccaccgggaaccucguggugccccgguacgcguucgccauggagcgcaacgccggcuccggcaucaucaucucggacacccccguccacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgugaucgagaagaugaacacccaguucaccgcggucggcaaggaguucaaccaccuggagaagcgcaucgagaaccugaacaagaagguggacgacggguuccucgacaucuggaccuacaacgccgagcugcugguccuccuggagaacgagcggacgcuggacuaccacgacagcaacgugaagaaccucuacgagaaggugcgcaaccagcugaagaacaacgccaaggagaucggcaacgggugcuucgaguucuaccacaagugcgacaacacgugcauggaguccgucaagaacggcaccuacgacuaccccaaguacucggaggaggccaagcugaaccgggaggagaucgacggggugaagcucgaguccacccgcaucuaccagauccuggccaucuacucgaccguggcguccagccugguccucguggugucccugggcgccaucucguucuggaugugcagcaacggcucccugcagugccggaucugcaucuga

SEQ ID NO: 10192 - RNA, 1701 nt, Artificial Sequence
  derived and/or modified CDS sequence (AUadapt) from InfluenzaA__AGJ73353__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucucggacacgcccgugcacgacugcaacacgaccugccagaccccgaagggcgccaucaacaccucccugcccuuccagagcauccaccccaucaccaucgggaagugccccaaguacgugaaguccaccaagcuccgccuggcgaccggccugcggaacgucccgucgauccagucccgcggccucuucggggccaucgccggguucaucgagggcggcuggacggggaugguggacggcugguacggguaccaccaccagaacgagcagggcagcggguacgccgccgaccugaaguccacccagaacgcgaucgacaagaucaccaacaaggugaacucggucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacuccaacgugaagaaccuguacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgcgaggagaucgacggcgugaagcuggaguccacccggaucuaccagauccuggcgaucuacagcaccgucgccucgucccucgugcugguggucagccugggggccaucuccuucuggaugugcagcaacggcucccuccagugccgcaucugcaucuga

SEQ ID NO: 10193 - RNA, 1701 nt, Artificial Sequence
  derived and/or modified CDS sequence (AUadapt) from InfluenzaA__AGJ73355__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagucgcggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaccucguucuggaugugcagcaacggcucccugcagugccggaucugcaucuga

SEQ ID NO: 10194 - RNA, 1701 nt, Artificial Sequence; identical to SEQ ID NO: 7112
  derived and/or modified CDS sequence (AUadapt) from InfluenzaA__AGJ73357__HA

SEQ ID NO: 10195 - RNA, 1701 nt, Artificial Sequence
  derived and/or modified CDS sequence (AUadapt) from InfluenzaA__AGJ73361__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccagcuccucgugguccuacaucguggagaccagcuccucggacaacggcacgugcuaccccggcgacuucaucgacuacgaggagcuccgggagcagcuguccagcguguccucguucgagcgcuucgagaucuuccccaagaccuccagcuggcccaaccacgacuccaacaagggggucaccgccgccugcccgcacgccggcgccaagggguucuacaagaaccugaucuggcucgugaagaagggcaacucguaccccaagcuguccaagagcuacaucaacgacaaggggaaggaggugcugguccucuggggcauccaccaccccucgaccacggcggaccagcagucccuguaccagaacgccgacaccuacguguucgugggcaccucgcgguacuccaagaaguucaagcccgagaucgccauccgcccgaagguccgggaccaggaggggcgcaugaacuacuacuggacccugguggagcccggcgacaagaucacguucgaggccaccgggaaccucguggucccccgguacgccuucgcgauggagcgcaacgccggcagcggcaucuucaucuccgacacccccgugcacgacugcaacaccacgugccagaccccgaagggggccaucaacaccucgcugcccuuccagaacauccaccccaucaccaucggcaagugccccaaguacgugaaguccacgaagcugcggcucgccaccgggcugcgcaacgucccgagcauccagucccggggccuguucggggccaucgcgggcuucaucgagggcggguggaccggcaugguggacgggugguacggcuaccaccaccagaacgagcaggggucgggcuacgccgccgaccucaaguccacccagaacgccaucgacaagaucacgaacaaggugaacagcgucaucgagaagaugaacacccaguucaccgccgugggcaaggaguucaaccaccuggagaagcgcaucgagaaccugaacaagaaggucgacgacggguuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgucgccucgucccuggugcucguggucagccugggcgcgaucucguucuggaugugcuccaacggcagccugcagugccggaucugcaucuga

SEQ ID NO: 10196 - RNA, 1701 nt, Artificial Sequence; identical to SEQ ID NO: 7295
  derived and/or modified CDS sequence (AUadapt) from InfluenzaA__AGJ73363__HA

SEQ ID NO: 10197 - RNA, 1701 nt, Artificial Sequence; identical to SEQ ID NO: 7112
  derived and/or modified CDS sequence (AUadapt) from InfluenzaA__AGJ73365__HA

SEQ ID NO: 10198 - RNA, 1701 nt, Artificial Sequence
  derived and/or modified CDS sequence (AUadapt) from InfluenzaA__AGJ73367__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggcccuacaucguggagaccucguccagcgacaacggcacgugcuaccccggcgacuucaucaacuacgaggagcuccgggagcagcuguccucgguguccucguucgagcgcuucgagaucuuccccaagaccuccagcuggccgaaccacgacuccaacaagggggucgccgccgccugcccccacgcgggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgaccagcagucccuguaccagaacgccgacgccuacguguucgugggcaccucgaaguacuccaagaaguucaagccggagaucgcgguccggcccaaggugcgcgaccaggagggccggaugaacuacuacuggacgcugguggagcccggggacaagaucaccuucgaggccaccggcaaccuccuggucccccgcuacgccuucgccauggagcggaacgccgggucgggcaucaucaucuccgacaccccggugcaggacugcaacacgaccugccagacccccaagggcgcgaucaacaccagccugcccuuccagaacauccaccccaucacgaucgggaagugcccgaaguacgugaaguccaccaagcuccgccuggccaccggccugcggaacguccccucgauccagucccgcggccucuucggggccaucgccggguucaucgagggcggcuggaccgggaugguggacggcugguacggguaccaccaccagaacgagcagggcagcggguacgccgcggaccugaaguccacgcagaacgccaucgacaagaucaccaacaaggugaacucggucaucgagaagaugaacacccaguucaccgccgugggcaaggaguucaaccaccuggagaagcggaucgagaaccucaacaagaaggucgacgacggcuuccuggacaucuggacguacaacgccgagcugcucgugcugcuggagaacgagcgcacccucgacuaccacgacuccaacgugaagaaccuguacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgcgaggagaucgacggcgugaagcuggagagcacccggaucuaccagauccuggccaucuacuccaccgucgccucgucccucgugcugguggucagccugggggccaucucguucuggaugugcuccaacggcagccuccagugccgcaucugcaucuga

SEQ ID NO: 10199 - RNA, 1701 nt, Artificial Sequence
  derived and/or modified CDS sequence (AUadapt) from InfluenzaA__AGJ73369__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggccgaggccaagcugaaccgggaggagaucgacggggugaagcucgaguccacccgcaucuaccagauccuggcgaucuacucgaccgucgccuccagccuggugcucguggucucccugggcgccaucucguucuggaugugcagcaacggcucccugcagugccggaucugcaucuga

SEQ ID NO: 10200 - RNA, 1701 nt, Artificial Sequence; identical to SEQ ID NO: 6699
  derived and/or modified CDS sequence (AUadapt) from InfluenzaA__AGJ73371__HA

SEQ ID NO: 10201 - RNA, 1701 nt, Artificial Sequence
  derived and/or modified CDS sequence (AUadapt) from InfluenzaA__AGJ73373__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccaccccuuccagaacauccaccccaucaccaucggcaagugccccaaguacgucaagagcacgaagcugcggcuggccaccgggcuccgcaacgugccguccauccagucgcggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 10202 - RNA, 1701 nt, Artificial Sequence
  derived and/or modified CDS sequence (AUadapt) from InfluenzaA__AGJ73375__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccgagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 10203 - RNA, 1701 nt, Artificial Sequence
  derived and/or modified CDS sequence (AUadapt) from InfluenzaA__AGJ73377__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccuccugcccgcgggccggcgccaagagcuucuacaagaaccugaucuggcucgugaagaaggggaacuccuaccccaagcugucgaagagcuacaucaacgacaagggcaaggaggugcugguccucugggggauccaccaccccuccaccacggcggaccagcagucgcuguaccagaacgccgacgccuacguguucgugggcaccucccgcuacucgaagaaguucaagcccgagaucgccauccggccgaagguccgcgaccaggagggccggaugaacuacuacuggacccugguggagcccggggacaagaucaccuucgaggccacgggcaaccuccuggugccccgcuacgcguucgccauggagcggaacgccggguccggcaucaucaucagcgacacccccguccacgacugcaacacgaccugccagaccccgaagggcgccaucaacaccucccugcccuuccagaacauccaccccaucaccaucgggaagugccccaaguacgucaagucgaccaagcuccgccuggccacgggccugcggaacgugccguccauccagagccgcgggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucaccaacaaggugaacuccgugaucgagaagaugaacacgcaguucaccgcggucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacucgaacgugaagaaccuguacgagaaggugcggaaccagcugaagaacaacgccaaggagaucgggaacggcugcuucgaguucaaccacaagugcgacaacacgugcauggaguccgucaagaacgggaccuacgacuaccccaaguacagcgaggaggccaagcucaacaaggaggagaucgacggcgugaagcuggaguccacccgcaucuaccagauccuggccaucuacucgaccguggcguccagccucguccugguggugucgcugggggccaucuccuucuggaugugcagcaacggcucccuccagugccggaucugcaucuga

SEQ ID NO: 10204 - RNA, 1701 nt, Artificial Sequence
  derived and/or modified CDS sequence (AUadapt) from InfluenzaA__AGJ73380__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccggggccaggaggggcgcaugaacuacuacuggacccugaucgagcccggcgacaagaucaccuucgaggcgacggggaaccucguggugccccgguacgccuucgccauggagcgcaacgccggcagcggcaucaucaucuccgacacccccguccacgacugcaacucgacgugccagaccccgaagggggccaucaacaccucccugcccuuccagaacauccaccccaucaccaucggcaagugccccaaguacgucaagagcaccaagcugcggcucgcgaccgggcugcgcaacgugccguccauccagucgcggggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggguuccucgacaucuggaccuacaacgccgagcuguucguccugcucgagaacgagcggacccuggacuaccacgacucgaacgugaaggaccuguacgagaaggugcgcaaccagcucaagaacaacgccaaggagaucggcaacgggugcuucgaguucuaccacaagugcgacaacacgugcauggaguccgucaagaacggcaccuacgacuaccccaaguacagcgaggaggccaagcugaaccgggagaagaucgacggggugaagcuggaguccacccgcaucuaccagauccucgcgaucuacucgaccguggccuccagccugguccugguggugucgcucggcgccaucuccuucuggaugugcagcaacggcucccugcagugccggaucugcaucuga

SEQ ID NO: 10205 - RNA, 1701 nt, Artificial Sequence
  derived and/or modified CDS sequence (AUadapt) from InfluenzaA__AGK62991__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaggccgugaucccgaacaucggcucccggccccgcauccggaacauccccagccgcaucuccaucuacuggaccaucgucaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggcgugcccccgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacaaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 10206 - RNA, 1701 nt, Artificial Sequence
  derived and/or modified CDS sequence (AUadapt) from InfluenzaA__AGK62993__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucucgaagugcaacuccgcgugcaucaccacgaacggcagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacgggugggagggcauggucgacggcugguacggguuccgccaccagaacuccgagggccgggggcaggcggccgaccugaaguccacccaggccgccaucgaccagaucaacggcaagcugaaccgccucaucgggaagaccaacgagaaguuccaccagaucgagaaggaguucuccgagguggagggccggauccaggaccuggagaaguacguggaggacaccaagaucgaccuguggucguacaacgccgagcuccuggucgcgcuggagaaccagcacacgaucgaccucaccgacuccgagaugaacaagcuguucgagaagaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucucguucgccaucuccugcuuccuccugugcgucgcgcugcucggcuucaucauguggagcugccagaagggcaacauccggugcaacaucugcaucuga

SEQ ID NO: 10207 - RNA, 1701 nt, Artificial Sequence
  derived and/or modified CDS sequence (AUadapt) from InfluenzaA__AGK62995__HA
augaagaccaucaucgcccugucguacauccucugccugguguucgcccagaagcugcccggcaacgacaacuccaccgcgacgcucugccuggggcaccacgccggcccgaacgggaccaucgucaagaccaucaccaacgaccagaucgaggugacgaacgccaccgagcuggugcagucguccagcaccggcgagaucugcgacucgccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgucgcugcggucccucguggccagcuccgggacgcuggaguucaacaacgagucguucaacuggaccggcgucacccagaacgggaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcagagcuccggccggaucaccgucucgacgaagcgcucgcagcaggccgugaucccgaacaucggcucccggccccgcauccggaacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacccccaacgggagcauccccaacgacaagccguuccagaacgucaaccgcaucacguacggcgccugcccccgguacgugaagcaguccacccugaagcucgcgaccgggaugcgcaacgugcccgagaagcagacccggggcaucuucggggccaucgccggcuucaucgagaacggcugggaggggauggucgacggcugguacggguuccgccaccagaacucggagggccgggggcaggccgccgaccugaaguccacgcaggcggccaucgaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucacggacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacaaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 10208 - RNA, 1701 nt, Artificial Sequence
  derived and/or modified CDS sequence (AUadapt) from InfluenzaA__AGK62997__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgucgcugcggucccucgucgccagcuccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgacaaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacgugcggggccugcgcccgguacgugaagcagaacacccugaagcucgccaccggcaugcgcaacgugcccgagaagcagacccgggggaucuucggcgccaucgcggucuucaucgagaacgggugggagggcaugguggacggcugguacggguuccgccaccagaacucggagggccgggagcaggccgccgccuuccaguccacgcaggccgcgaucgaccagaucaucgggaagcugaaccgccugaucggcgagaccaacgagaaguuccaccagaucgagaaggaguucagcgagguggagcggcgcauccaggcccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggcuccauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcucugcguggcccugcugggcuucaucaugugguccugccagaaggggaacauccgcugcaacaucugcaucuga

SEQ ID NO: 10209 - RNA, 1701 nt, Artificial Sequence
  derived and/or modified CDS sequence (AUadapt) from InfluenzaA__AGK62999__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10210 - RNA, 1701 nt, Artificial Sequence
  derived and/or modified CDS sequence (AUadapt) from InfluenzaA__AGK63001__HA
augaagaccaucaucgcccugucguacauccucugccugguguucgcccagaagcugcccggcaacgacaacuccaccgcgacgcucugccugguccaccacgccgugccgaacgggaccaucgugaagaccaucaccaacgaccagaucgaggucacgaacgccaccgagcuggugcagagcuccucgaccggcgagaucugcgacagcccccaccagauccucgacggggagaacugcacccugaucgacgcccugcucggcgacccccagugcgacggguuccagaacaaggagugggaccuguucguggagcgcuccaaggccuacuccaacugcuaccccuacgacgucccggacuacgcgagccugcggucccucguggccucguccggcacgcuggaguucaacaacgagagcuucaacuggaccggcgugacccagaacgggaccuccagcgccugcauccgccgguccaacucguccuucuucagccgccugaacggccucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccagcgggcggaucaccgugucgacgaagcgcucccagcaggccgucaucccgaacaucggcagccggccccgcauccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacagcgagugcaucacccccaacggcuccauccccaacgacaagccguuccagaacgugaaccgcaucacguacggggccugcccccgguacgucaagcagucgacccugaagcucgcgaccggcaugcgcaacgugcccgagaagcagacccgggggaucuucggcgccaucgccggguucaucgagaacggcugggagggcaugguggacgggugguacggcuuccgccaccagaacuccgaggggcgggagcaggccgccgacuuccagagcacgcaggcggccaucgaccagaucaucggcaagcugaaccgccugaucgggaagaccaacgagaaguuccaccagaucgagaaggaguucuccgaggucgagcggcgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacggcugcuucaagaucuaccacaagugcgacaacgcgugcaucgggucgauccggaacggcaccuacaaccacgacgucuaccgcgacgaggcccugaacaaccgguuccagaucaaggggguggagcucaaguccggcuacaaggacuggauccuguggaucagcuucgccaucagcugcuuccugcucugcguggcccugcugggguucaucaugugguccugccagaagggcaacauccgcugcaacaucugcaucuga

SEQ ID NO: 10211 - RNA, 1701 nt, Artificial Sequence
  derived and/or modified CDS sequence (AUadapt) from InfluenzaA__AGK63003__HA
augaagaccaucaucgcccugucguacauccucugccugguguucgcccagaagcugcccggcaacgacaacuccaccgcgacgcucugccuggggcaccacgccggcccgaacgggaccaucgucaagaccaucaccaacgaccagaucgaggugacgaacgccaccgagcuggugcagucguccagcaccggcgagaucugcgacucgccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgucccggacuacgcgucgcugcggucccucguggccagcuccgggacgcuggaguucaacaacgagucguucaacuggaccggcgugacccagaacgggaccuccagcgccugcauccgccgguccaacucguccuucuucagccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaguccucgggccggaucaccgugagcacgaagcgcucccagcaggccgucaucccgaacaucggcucgcggccccgcauccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggccugcaucacccccaacggguccauccccaacgacaagccguuccagaacgugaaccgcaucacguacggcgcgugcccccgguacgucaagcagagcacccugaagcucgccaccgggaugcgcaacgugcccgagaagcagacccggggcaucuucggggccaucgccggcuucaucgagaacggcugggaggggaugguggacggcugguacggguuccgccaccagaacuccgagggccgggggcaggccgcggaccugaaguccacgcaggccgccaucgaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggucguacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcagcauccgcaacgggaccuacaaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggcgugccagaagggcaacauccggugcaacaucugcaucuga

SEQ ID NO: 10212 - RNA, 1701 nt, Artificial Sequence
  derived and/or modified CDS sequence (AUadapt) from InfluenzaA__AGK63005__HA
augaagaccaucaucgcccugucguacauccucugccugguguucgcccagaagcugcccggcaacgacaacuccaccgcgacgcucugccugguccaccacgccgugccgaacgggaccaucgugaagaccaucaccaacgaccagaucgaggucacgaacgccaccgagcuggugcagagcuccucgaccggcgagaucugcgacagcccccaccagauccucgacggggagaacugcacccugaucgacgcccugcucggcgacccccagugcgacggguuccagaacaagaagugggaccuguucguggagcgcuccaaggccuacuccaacugcuaccccuacgacgucccggacuacgcgagccugcggucccucguggccucguccggcacgcuggaguucaacaacgagagcuucaacuggaccggcgugacccagaacgggaccuccucggccugcauccgccgguccaacagcuccuucuucagccgccugaacggccucacgcaccugaacuucaaguaccccgcccuggacgucaccaugcccaacaacgacaaguucgacaagcucuacaucuggggcgugcaccaccccgggaccgacaaggaccagaucuuccuguacgcgcaguccucggggcggaucaccgugagcacgaagcgcucccagcaggccgucaucccgaacaucggcucgcggccccgcauccggaacauccccucccgcaucagcaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagucgacccugaagcucgcgaccggcaugcgcaacgugcccgagaagcagacccgggggaucuucggcgccaucgccguguucaucgagaacgggugggagggcauggucgacggcugguacggguuccgccaccagaacuccgagggccgggagcaggccgccgacuuccagagcacgcaggcggccaucgaccagaucaacgggaagcugaaccgccugaucggcaagaccaacgagaaguuccaccagaucgagaaggaguucuccgagguggaggggcggauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacaugggcaacggcugcuucaagaucuaccacaagugcgacaacgcgugcaucgggucgauccgcaacggcaccuacaaccacgacguguaccgggacgaggcccugaacaaccgcuuccagaucaaggggguggagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 10213 - RNA, 1701 nt, Artificial Sequence
  derived and/or modified CDS sequence (AUadapt) from InfluenzaA__AGK63007__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 10214 - RNA, 1701 nt, Artificial Sequence
  derived and/or modified CDS sequence (AUadapt) from InfluenzaA__AGK63009__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggccugcagaacaagaagugggaccuguucguggagcgcucgaaggcccacuccaacugcuaccccuacgacgugccggacuacgcgagccuccggucccuggucgccucguccggcacgcuggaguucaacaacgagucguucaacuggaccggggugacccagaacggcaccuccagcgccugcauccgccgguccaacaacucguucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugucgaucuacuggaccaucgugaagcccggcgacauccuccugaucaacuccaccgggaaccugaucgccccgcggggcuacuucaagauccgcagcgggaaguccucgaucaugcgguccgacgcccccaucggcaagugcaacucggcgugcaucacccccaacggcuccauccccaacgacaagccguuccagaacgucaaccgcaucacguacggggccugcccccgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcucaaccgccugaucggcaagaccaacgagaaguuccaccagaucgagaaggaguucucggagguggagggccggauccaggaccuggagaaguacguggaggacaccaagaucgaccucugguccuacaacgccgagcugcuggucgcgcucgagaaccagcacaccaucgaccugacggacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 10215 - RNA, 1701 nt, Artificial Sequence
  derived and/or modified CDS sequence (AUadapt) from InfluenzaA__AGK63011__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagucgacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 10216 - RNA, 1701 nt, Artificial Sequence
  derived and/or modified CDS sequence (AUadapt) from InfluenzaA__AGK63013__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccuggacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcgcccgguacgugaagcagaacacccugaagcucgccaccggcaugcgcaacgugcccgagaagcagacccgggggaucuucggcgccaucgcggucuucaucgagaacgggugggagggcaugguggacggcugguacggguuccgccaccagaacucggagggccgggggcaggccgccgcccugcaguccacgcaggccgcgaucgaccagaucaccggcaagcugaaccgccucaucggggagaccaacgagaaguuccaccagaucgagaaggaguucagcgagguggagggccggauccaggcccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugguccugccagaagggcaacauccggugcaacaucugcaucuga

SEQ ID NO: 10217 - RNA, 1701 nt, Artificial Sequence
  derived and/or modified CDS sequence (AUadapt) from InfluenzaA__AGK63015__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgcaaguccaacagcuccuucuucucgcggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcgcaucaccgugucgacgaagcggucccagcaggccgugaucccgaacaucggcagccgcccccggauccgcaacauccccucccggaucucgaucuacuggaccaucgucaagcccggcgacauccugcucaucaacuccaccgggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagucgacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 10218 - RNA, 1701 nt, Artificial Sequence; identical to SEQ ID NO: 7227
  derived and/or modified CDS sequence (AUadapt) from InfluenzaA__AGK63017__HA

SEQ ID NO: 10219 - RNA, 1701 nt, Artificial Sequence
  derived and/or modified CDS sequence (AUadapt) from InfluenzaA__AGK63019__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 10220 - RNA, 1701 nt, Artificial Sequence; identical to SEQ ID NO: 10094
  derived and/or modified CDS sequence (AUadapt) from InfluenzaA__AGK63021__HA

SEQ ID NO: 10221 - RNA, 1701 nt, Artificial Sequence
  derived and/or modified CDS sequence (AUadapt) from InfluenzaA__AGK63025__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucaucgagcgcucgaaggccuacuccaacugcuaccccuacgacgugccggacuacgcgagccugcggucccucguggccucguccggcacgcuggaguucaacaacgagagcuucaacuggaccggggucacccagaacggcaccuccucggccugcauccgcaaguccaacagcuccuucuucucgcggcugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaguccagcgggcgcaucaccgucucgacgaagcggucccagcaggccgugaucccgaacaucggcagccgcccccggauccgcaacauccccucccggaucucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgucaaccggaucacguacggggccugcccccgcuacgugaagcagucgacccugaagcucgcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacaaccacgacguguaccgcgacgaggcccucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 10222 - RNA, 1701 nt, Artificial Sequence; identical to SEQ ID NO: 9319
  derived and/or modified CDS sequence (AUadapt) from InfluenzaA__AGK63027__HA

SEQ ID NO: 10223 - RNA, 1701 nt, Artificial Sequence
  derived and/or modified CDS sequence (AUadapt) from InfluenzaA__AGK63029__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucaccacgaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggcggccgaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10224 - RNA, 1701 nt, Artificial Sequence
  derived and/or modified CDS sequence (AUadapt) from InfluenzaA__AGK63031__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaagaagaagugggaccuguucguggagcgcuccaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaucaugcccaacaacgagcaguucgacaagcucuacaucuggggcguccaccaccccgggaccgacaaggaccagaucuuccuguacgcgcaggccagcgggcggaucaccguguccaccaagcgcucgcagcaggccgugaucccgaacaucggcagccggccccgcguccggaacauccccucccgcgugucgaucuacuggacgaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacccccaacggcuccauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagacgaacgagaagcugcaccagaucgagaaggaguucucggagguggagggccggauccuggaccucgagaaguacguggaggacaccaagaucgaccugugguccuacaacgccgagcugcucgucgcgcuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagucgggcuacaaggacuggauccuguggaucuccuucgccaucagcugcuuccugcucugcgucgcgcugcugggcuucaucaugugggccugccagaaggggaacauccggugcaacaucugcaucuga

SEQ ID NO: 10225 - RNA, 1701 nt, Artificial Sequence
  derived and/or modified CDS sequence (AUadapt) from InfluenzaA__AGK63033__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccugaucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgcaaguccaacucguccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcgcaucaccgugucgacgaagcggucgcagcaggccgugaucccgaacaucggcucccgcccccggauccgcaacauccccagccggaucuccaucuacuggaccaucgucaagcccggcgacauccugcucaucaacucgaccgggaaccugaucgccccgcgcggcuacuucaagauccgguccgggaaguccuccaucaugcgcagcgacgcccccaucggcaagugcaacuccgagugcaucacccccaacggcucgauccccaacgacaagccguuccagaacgugaaccggaucacguacggggcgugcccccgcuacgugaagcaguccacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 10226 - RNA, 1701 nt, Artificial Sequence
  derived and/or modified CDS sequence (AUadapt) from InfluenzaA__AGK63035__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggcgugcccccgguacgugaagcagucgacccugaagcucgccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 10227 - RNA, 1701 nt, Artificial Sequence
  derived and/or modified CDS sequence (AUadapt) from InfluenzaA__AGK63037__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcaaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgcccagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10228 - RNA, 1701 nt, Artificial Sequence
  derived and/or modified CDS sequence (AUadapt) from InfluenzaA__AGK63039__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaagaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugacccuccccaacaacgagcaguucgacaagcuguacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccuccugaucaacuccaccgggaaccugaucgccccgcggggcuacuucaagauccgcucggggaaguccagcaucaugcgguccgacgcccccaucucgaagugcaacuccgcgugcaucacccccaacggcagcauccccaacgacaagccguuccagaacgucaaccgcaucacguacggcgccugcccccgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacuccgagggccgggggcaggcggccgaccugaaguccacgcaggccgccaucgaccagaucaacggcaagcucaaccgccugaucgggaagaccaacgagaaguuccaccagaucgagaaggaguucuccgagguggagggccggauccaggaccuggagaaguacguggaggacaccaagaucgaccucuggucguacaacgccgagcugcuggucgcgcucgagaaccagcacaccaucgaccugacggacuccgagaugaacaagcuguucgagaagaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcccugaacaaccgcuuccagaucaagggcguggagcugaaguccggguacaaggacuggauccucuggaucucguucgccaucuccugcuuccugcugugcgucgcgcuccugggcuucaucauguggagcugccagaagggcaacauccggugcaacaucugcaucuga

SEQ ID NO: 10229 - RNA, 1701 nt, Artificial Sequence
  derived and/or modified CDS sequence (AUadapt) from InfluenzaA__AGK63041__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggccugcagaacaagaagugggaccugaucguggagcgcucgaaggcccacuccuacugcuaccccuacgacgugccggacuacgcgagccuccggucccuggucgccucguccggcacgcuggaguucaacaacgagucguucaacuggaccgaggugacccagaacgggaccuccagcgccugcauccgccgguccaacaacucguucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccucgggccggaucaccguguccacgaagcgcagccagcaggccgugaucccgaacaucgggucgcggccccgcguccggaacauccccucccgcgugucgaucuacuggaccaucgugaagcccggcgacauccuccugaucaacuccaccggcaaccugaucgccccgcggggguacuucaagauccgcagcggcaaguccucgaucaugcgguccgacgcccccaucgggaagugcaacucggcgugcaucacccccaacggcuccauccccaacgacaagccguuccagaacgucaaccgcaucacguacggcgccugcccccgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggccgggggcaggcggccgaccugaaguccacgcaggccgccaucgaccagaucaacggcaagcucaaccgccugaucgggaagaccaacgagaaguuccaccagaucgagaaggaguucucggagguggagggccggauccaggaccuggagaaguacguggaggacaccaagaucgaccucugguccuacaacgccgagcugcuggucgcgcucgagaaccagcacaccaucgaccugacggacucggagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucuccuucgccaucagcugcuuccugcugugcgucgcgcuccugggcuucaucaugugggccugccagaagggcaacauccggugcaacaucugcaucuga

SEQ ID NO: 10230 - RNA, 1701 nt, Artificial Sequence
  derived and/or modified CDS sequence (AUadapt) from InfluenzaA__AGK63043__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagucgacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 10231 - RNA, 1701 nt, Artificial Sequence
  derived and/or modified CDS sequence (AUadapt) from InfluenzaA__AGK63045__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaagaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgcaaguccaacagcuccuucuucucgcggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcgcaucaccgugagcacgaagcggucgcagcaggccgugaucccgaacaucggcucccgcccccggauccgcaacauccccagccggaucuccaucuacuggaccaucgucaagcccggcgacauccugcucaucaacucgaccgggaaccugaucgccccgcgcggcuacuucaagauccgguccgggaaguccuccaucaugcgcagcgacgcccccaucggcaagugcaacuccgagugcaucacccccaacggcucgauccccaacgacaagccguuccagaacgugaaccggaucacguacggggcgugcccccgcuacgugaagcaguccacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucucggagguggagggccgcauccaggaccuggagaaguacgucgaggacaccaagaucgaccugugguccuacaacgcccagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 10232 - RNA, 1701 nt, Artificial Sequence
  derived and/or modified CDS sequence (AUadapt) from InfluenzaA__AGK63047__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccgcgagggccggaugaacuacuacuggacccugaucgagcccggggacaagaucaccuucgaggcgacgggcaaccucguggugccccgcuacgccuucgccauggagcggaacgccgggucgggcaucaucaucuccgacacccccguccacgacugcaacaccgccugccagaccccggagggcgcgaucaacacgagccugcccuuccagaacauccaccccaucaccaucgggaagugccccaaguacgugaaguccaccaagcugcgccucgccaccggccugcggaacgugccgucgauccagucccgcgggcuguucggcgccaucgccggguucaucgagggcggcuggacggggauggucgacggcugguacggguaccaccaccagaacgagcagggcagcggguacgccgcggaccucaaguccacccagaacgccaucgacaagaucaccaacaaggugaacucggugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggcgaagcugaaccgcgagaagaucgacggcgugaagcucgagagcacccggaucuaccagauccuggccaucuacuccaccguggccucgucccugguccucguggugagccugggggccaucucguucuggaugugcuccaacggcagccugcagugccgcaucugcaucuga

SEQ ID NO: 10233 - RNA, 1683 nt, Artificial Sequence; identical to SEQ ID NO: 86
  derived and/or modified CDS sequence (AUadapt) from InfluenzaA__AGK82158__HA

SEQ ID NO: 10234 - RNA, 1683 nt, Artificial Sequence
  derived and/or modified CDS sequence (AUadapt) from InfluenzaA__AGK84857__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggaaggguccgacgugugcuaccccggcaaguucgugaacgaggaggcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggauaacgcggccuucccgcagaucaccaaguccuacaagaacacccgcaagagccccgcccucaucgucuggggcauccaccacuccgugagcaccgccgagcaaacgaagcuguauggguccggcaacaagcuggugaccgucggcagcuccaacuaccagcagagcuucgugcccucccccggggcccggccccaggugaacggccucagcgggcggaucgacuuucacuggcugaugcugaaccccaacgacaccgucaccuucagcuucaacggcgcguuuaucgcccccgaccgcgccuccuuccuccggggcaagagcauggggauccaguccggcguccagguggacgccaacugcgagggggacugcuaccauagcggcgggacgaucaucuccaaccugcccuuccagaacaucgacagccgcgccgugggcaagugcccgcgguacgugaagcagcgcucccugcuccuggcgaccgggaugaagaaugugcccgaaauccccaagggccggggccuguucggggccaucgccggcuucaucgagaacgggugggagggccucaucgacgggugguacggcuuccgccaccagaacgcccagggcgaggggaccgccgcggacuauaagagcacccaguccgccaucgaccagaucacgggcaagcugaaccggcugaucgagaagaccaaccagcaauucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaagcuguacgagcgcgugaagcggcaacugcgcgagaacgcggaggaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 10235 - RNA, 1683 nt, Artificial Sequence
  derived and/or modified CDS sequence (AUadapt) from InfluenzaA__AGK84860__HA
augaauacccaaauccugguguucgcccucaucgccaucauccccaccaacgcggacaagaucugccugggccaccacgccgucagcaacgggacgaaggugaacacccugaccgagcgcggcguggaggucgugaaugccaccgagacgguggagcggaccaacaucccgcgcaucugcuccaaggggaagaugaccgucgaccucggccagugcgggcugcugggcaccaucacgggcccgccccagugcgaccaguuccucgaguucagcgccgaucugaucaucgagcggcgcgagggguccgacgugugcuaccccggcaaguucgugaacgaggaagcccugcggcagauccuccgcgagagcgggggcaucgacaaggaggcgaugggguucaccuacuccggcauccggaccaauggcgccaccagcgccugccgccgguccgggagcuccuucuacgccgagaugaaguggcugcugagcaacacggacaacgcggccuuuccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaauuaccagcagagcuucgugcccucccccggggcccggccccaggugaacggccucagcgggcgcaucgacuuccacuggcugaugcugaaccccaaugacaccgucaccuucagcuucaacggcgcguucaucgcccccgaccgggccuccuuccuccgcggcaaaagcauggggauccaguccggcguccagguggaugccaacugcgagggggacugcuaccacagcggcgggacgaucaucuccaaccugcccuuccagaacaucgauagccgggccgugggcaagugcccgcgcuacgugaagcagcggucccugcuccuggcgaccgggaugaagaacgugcccgagauccccaagggccgcggccuguucggggccaucgccggcuucaucgagaacgggugggagggccucaucgacgggugguacggcuuucggcaccagaacgcccagggcgaggggaccgccgcggacuacaagagcacccaauccgccaucgaccagaucacgggcaagcugaaccgccugaucgagaagaccaaccagcaguucgagcucaucgauaacgaguucaacgaggucgagaagcagaucgggaacgugaucaacuggacccgggacagcaucaccgaggugugguccuacaacgccgagcugcuggucgccauggagaaucagcacacgaucgaccucgccgacagcgagauggacaaacuguacgagcgcgugaagcgccagcugcgggagaacgcggaggaggacggcaccggcugcuuugagaucuuccacaagugcgacgacgacugcauggccuccauccgcaacaacaccuaugaccacagcaaguaccgggaggaggccaugcagaaccgcauccagaucgaccccgucaagcucuccagcggguacaaggacgugauccugugguuuuccuucggcgccagcugcuucauccugcucgcgaucgugauggggcuggucuucaucugcgugaagaacggcaacaugcggugcaccaucugcaucuga

SEQ ID NO: 10236 - RNA, 1683 nt, Artificial Sequence
  derived and/or modified CDS sequence (AUadapt) from InfluenzaA__AGK84863__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagaagaccgucgaccucggccagugcgggcugcugggcaccaucacgggcccgccccagugcgaccaguuccucgaguucagugccgaccugaucaucgagcggcgcgagggguccgacgugugcuaccccggcaaguucgugaacgaggaggcccugcggcagauccuccgcgagagcgggggcaucgacaaggaagcgaugggguuuaccuacuccggcauccggaccaacggcgccaccagcgccugccgccgguccgggagcuccuucuacgccgagaugaaguggcugcugagcaacacggauaacgcggccuucccgcagaugaccaaguccuacaagaacacccgcaagagccccgcccucaucgucuggggcauccaccacuccgugagcaccgccgagcagacgaagcuguauggguccggcaacaagcuggugaccgucggcagcuccaacuaccagcagagcuucgugcccucccccggggcccggccccaggugaacggccucagcgggcgcaucgacuuucacuggcugaugcugaaccccaacgacaccgucaccuucagcuucaacggcgcguuuaucgcccccgaccgggccuccuuccuccgcggcaagagcauggggauccaguccggcguccagguggacgccaacugcgagggggacugcuaccauagcggcgggacgaucaucuccaaccugcccuuccagaacaucgacagccgggccgugggcaagugcccgcgcuacgugaagcagcggucccugcuccuggcgaccgggaugaaaaaugugcccgagauccccaagggccgcggccuguucggggccaucgccggcuucaucgagaacgggugggagggccucaucgacgggugguacggcuuccggcaccagaacgcccagggcgaggggaccgccgcggacuauaagagcacccaguccgccaucgaccagaucacgggcaagcugaaccgccugaucgagaagaccaaccagcaguucgagcucaucgacaacgaguucaaugaggucgagaagcagaucgggaacgugaucaacuggacccgggacagcaucaccgaagugugguccuacaacgccgagcugcuggucgccauggagaaccagcacacgaucgaccucgccgauagcgagauggacaagcuguacgagcgcgugaagcgccagcugcgggagaacgcggaggaggacggcaccggcugcuucgagaucuuccauaagugcgacgacgacugcauggccuccauccgcaacaacaccuacgaccauagcaaguaccgggaggaggccaugcagaaccgcauccagaucgaccccgucaagcucuccagcggguacaaggacgugauccugugguucuccuuuggcgccagcugcuucauccugcucgcgaucgugauggggcuggucuucaucugcgugaagaacggcaacaugcggugcaccaucugcaucuga

SEQ ID NO: 10237 - RNA, 1701 nt, Artificial Sequence
  derived and/or modified CDS sequence (AUadapt) from InfluenzaA__AGL07713__HA
augaaggccauccuggugguccuccuguacaccuucgccaccgcgaacgccgacacgcugugcaucggcuaccacgccaacaacucgaccgacaccguggacaccgugcucgagaagaacgucacggugacccgcuccgugaaccugcuggaggacaagcacaacgggaagcucugcaagcugcggggcgucgcgccccugcaccucgggaagugcaacaucgccggcuggauccuggggaacccggagugcgagucgcuguccaccgccucguccuggagcuacaucguggagaccuccucguccgacaacggcacgugcuaccccggcgacuucaucgacuacgaggagcuccgcgagcagcugucguccgugagcuccuucgagcgguucgagaucuuccccaagaccgggucguggcccaaccacgacuccaacaagggcgucaccgccgccugcccgcacgccggggcgaagggcuucuacaagaaccugaucuggcucguggagaaggggaacucguaccccaagcuguccaagagcuacaucaacgacaagggcaaggaggugcugguccucuggggcauccaccaccccuccaccacggccgaccagcagcgccuguaccagaacgccgacaccuacguguucguggggaccucgcgguacucgaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggcuccgggaucaucaucagcgacacccccgugcacgacugcaacaccacgugccagaccccgaagggcgccaucaacaccucccugcccuuccagaacauccaccccaucaccaucgggaagugccccaaguacgucaagucgacgaagcugcggcucgccaccggccugcgcaacgugccguccauccagucgcgggggcuguucggcgcgaucgccggcuucaucgagggcggguggaccgggaugguggacggcugguacggguaccaccaccagaacgagcagggcuccggcuacgccgccgaccucaagagcacccagaacgccaucgacaagaucacgaacaaggugaacuccgucaucgagaagaugaacacccaguucaccgcgguggggaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggccaucuacagcaccgucgcguccucgcuggugcucguggucucccugggcgccaucucguucuggaugugcuccaacgggagccugcagugccggaucugcaucuga

SEQ ID NO: 10238 - RNA, 1701 nt, Artificial Sequence
  derived and/or modified CDS sequence (AUadapt) from InfluenzaA__AGL09731__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcaacuccucguucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10239 - RNA, 1701 nt, Artificial Sequence; identical to SEQ ID NO: 162
  derived and/or modified CDS sequence (AUadapt) from InfluenzaA__AGL09732__HA

SEQ ID NO: 10240 - RNA, 1701 nt, Artificial Sequence
  derived and/or modified CDS sequence (AUadapt) from InfluenzaA__AGL09734__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucaucgagcgguccaaggccuacagcaacugcuaccccuacgacgugccggacuacgcgucccugcgcucgcugguggccuccagcggcacccucgaguucaacaacgaguccuucaacuggacgggggucacccagaacggcaccagcuccgccugcauccggcgcucgaacuccagcuucuucucccggcugaacuggcugacccaccucaacuucaaguaccccgcccugaacgugacgaugcccaacaacgagcaguucgacaagcuguacaucuggggcgugcaccaccccgggaccgacaaggaccagaucuuccucuacgcgcagucguccgggcgcaucaccgucagcaccaagcggagccagcaggccgugaucccgaacaucggcucccgcccccggauccgcaacauccccucgcggaucuccaucuacuggacgaucgugaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcagcauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcauggucgacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 10241 - RNA, 1701 nt, Artificial Sequence
  derived and/or modified CDS sequence (AUadapt) from InfluenzaA__AGL09735__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagucgggcuacaaggacuggauccuguggaucuccuucgccaucagcugcuuccugcugugcguggcccugcucggguucaucaugugggcgugccagaagggcaacauccggugcaacaucagcaucuga

SEQ ID NO: 10242 - RNA, 1701 nt, Artificial Sequence
  derived and/or modified CDS sequence (AUadapt) from InfluenzaA__AGL09736__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 10243 - RNA, 1701 nt, Artificial Sequence; identical to SEQ ID NO: 10128
  derived and/or modified CDS sequence (AUadapt) from InfluenzaA__AGL09737__HA

SEQ ID NO: 10244 - RNA, 1701 nt, Artificial Sequence
  derived and/or modified CDS sequence (AUadapt) from InfluenzaA__AGL09739__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcuccugcuaccccuacgacgugccggacuacgcgucgcugcgcucccucgucgccagcuccggcacccuggaguucaacaacgagucguucaacuggacgggggugacccagaacggcaccuccagcgccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccgugucgaccaagcggucccagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 10245 - RNA, 1701 nt, Artificial Sequence; identical to SEQ ID NO: 10080
  derived and/or modified CDS sequence (AUadapt) from InfluenzaA__AGL09740__HA

SEQ ID NO: 10246 - RNA, 1701 nt, Artificial Sequence; identical to SEQ ID NO: 9319
  derived and/or modified CDS sequence (AUadapt) from InfluenzaA__AGL09741__HA

SEQ ID NO: 10247 - RNA, 1701 nt, Artificial Sequence
  derived and/or modified CDS sequence (AUadapt) from InfluenzaA__AGL09742__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagacccagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugcggucgggcuacaaggacuggauccuguggaucuccuucgccaucagcugcuuccuccugugcgucgcgcugcucggcuucaucaugugggccugccagaaggggaacauccgcugcuccaucugcaucuga

SEQ ID NO: 10248 - RNA, 1701 nt, Artificial Sequence; identical to SEQ ID NO: 10103
  derived and/or modified CDS sequence (AUadapt) from InfluenzaA__AGL09744__HA

SEQ ID NO: 10249 - RNA, 1701 nt, Artificial Sequence
  derived and/or modified CDS sequence (AUadapt) from InfluenzaA__AGL09745__HA
augaagaccaucaucgcccugucguacauccucugccugguguucgcccagaagcugcccggcaacgacaacuccaccgcgacccucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacguggggaacggcugcuucaagaucuaccacaagugcgacaacacgugcaucggguccauccggaacggcaccuacgaccacaacgucuaccgcgacgaggcgcucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10250 - RNA, 1701 nt, Artificial Sequence; identical to SEQ ID NO: 10242
  derived and/or modified CDS sequence (AUadapt) from InfluenzaA__AGL09746__HA

SEQ ID NO: 10251 - RNA, 1701 nt, Artificial Sequence; identical to SEQ ID NO: 10080
  derived and/or modified CDS sequence (AUadapt) from InfluenzaA__AGL09747__HA

SEQ ID NO: 10252 - RNA, 1701 nt, Artificial Sequence; identical to SEQ ID NO: 10103
  derived and/or modified CDS sequence (AUadapt) from InfluenzaA__AGL09748__HA

SEQ ID NO: 10253 - RNA, 1701 nt, Artificial Sequence; identical to SEQ ID NO: 10101
  derived and/or modified CDS sequence (AUadapt) from InfluenzaA__AGL09749__HA

SEQ ID NO: 10254 - RNA, 1701 nt, Artificial Sequence; identical to SEQ ID NO: 162
  derived and/or modified CDS sequence (AUadapt) from InfluenzaA__AGL09750__HA

SEQ ID NO: 10255 - RNA, 1701 nt, Artificial Sequence; identical to SEQ ID NO: 10080
  derived and/or modified CDS sequence (AUadapt) from InfluenzaA__AGL09751__HA

SEQ ID NO: 10256 - RNA, 1701 nt, Artificial Sequence; identical to SEQ ID NO: 162
  derived and/or modified CDS sequence (AUadapt) from InfluenzaA__AGL09753__HA

SEQ ID NO: 10257 - RNA, 1701 nt, Artificial Sequence
  derived and/or modified CDS sequence (AUadapt) from InfluenzaA__AGL09754__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagucgggcuacaaggacuggauccuguggaucuccuucgccaucagcugccugcugcugugcguggcccuccugggcuucaucaugugggccugccagaaggggaacauccgcugcaacaucugcaucuga

SEQ ID NO: 10258 - RNA, 1701 nt, Artificial Sequence; identical to SEQ ID NO: 10242
  derived and/or modified CDS sequence (AUadapt) from InfluenzaA__AGL09756__HA

SEQ ID NO: 10259 - RNA, 1701 nt, Artificial Sequence
  derived and/or modified CDS sequence (AUadapt) from InfluenzaA__AGL09758__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagaucugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaagggguucuacaagaaccugaucuggcuggugaagaagggcaacuccuaccccaagcucagcaacuccuacaucaacgacaaggggaaggaggugcugguccuguggggcauccaccaccccucgaccacggccgaccagcagagccucuaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucagcgacaccaccgugcacgacugcaacacgaccugccagacccccaagggggccaucaacaccucccucccguuccagaacauccaccccaucacgaucggcaagugccccaaguacgucaagucgaccaagcugcggcuggccaccgggcuccgcaacgugcccuccauccagucgcggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccuggacaucuggacguacaacgccgagcuccuggugcugcucgagaacgagcggacccuggacuaccacgacucgaacgugaagaaccuguacgagaagguccgcaaccagcucaagaacaacgccaaggagaucggcaacgggugcuucgaguucuaccacaagugcgacaacaugugcauggaguccgugaagaacggcaccuacgacuacccgaaguacagcgaggaggccaagcugaaccgggagaagaucgacggggugaagcuggaguccacccgcaucuaccagauccucgccaucuacucgacggucgcguccagccuggugcugguggucucccucggcgccaucucguucuggaugugcagcaacggcucccugcagugccggaucugcaucuga

SEQ ID NO: 10260 - RNA, 1701 nt, Artificial Sequence
  derived and/or modified CDS sequence (AUadapt) from InfluenzaA__AGL09760__HA
augaagaccaucaucgccgugucguacauccugugccucgucuucgcccaggagcugcccggcaacgacgacuccaccgcgacgcugugccucgggcaccacgccgugccgaacggcaccaucgugaagaccaucaccaacgaccagaucgaggucacgaacgccaccgagcuggugcagucguccagcaccggggagaucugcaacucgccccaccagauccuggacggcgagaacugcacccucaucgacgcccugcugggggacccccagugcgacggcuuccagaacaagaagugggaccucuucguggagcgcuccaaggcccacuccaacugcuaccccuacgacgucccggacuacgcgucgcugcggucccugguggccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccucggggcggaucaccguguccacgaagcgcagccagcaggccgucaucccgaacaucggcucgcggccccgcgugcggaacauccccucccgcgugucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccucaaguccacgcaggccgccaucgaccagaucaacgggaagcugaaccgccugaucggcaagaccaacgagaaguuccaccagaucgagaaggaguucucggagguggagggccggauccaggaccucgagaaguacgucgaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagucgggcuacaaggacuggauccuguggaucuccuucgccaucagcugcuuccugcucugcguggcgcugcugggcuucaucaugugggccugccagaaggggaacauccggugcaacaucugcaucuga

SEQ ID NO: 10261 - RNA, 1701 nt, Artificial Sequence; identical to SEQ ID NO: 10113
  derived and/or modified CDS sequence (AUadapt) from InfluenzaA__AGL09761__HA

SEQ ID NO: 10262 - RNA, 1701 nt, Artificial Sequence
  derived and/or modified CDS sequence (AUadapt) from InfluenzaA__AGL09762__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgcgggagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggucgcagcaggccgugaucccgaacaucggcucccgcccccggauccgcaacauccccagccggaucuccaucuacuggacgaucgucaagcccggggacauccugcucaucaacucgaccggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 10263 - RNA, 1701 nt, Artificial Sequence; identical to SEQ ID NO: 162
  derived and/or modified CDS sequence (AUadapt) from InfluenzaA__AGL09763__HA

SEQ ID NO: 10264 - RNA, 1701 nt, Artificial Sequence
  derived and/or modified CDS sequence (AUadapt) from InfluenzaA__AGL09764__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggucgcuggucgccuccagcggcacccucgaguucaacaacgaguccuucaacuggacgggggugacccagaacggcaccucguccgccugcauccgccggagcaacuccucguucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcugaucaacucgaccgggaaccucaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcuggcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccucaaguccacccaggcggccaucgaccagaucaacgggaagcugaaccgccugaucggcaagacgaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 10265 - RNA, 1701 nt, Artificial Sequence; identical to SEQ ID NO: 10103
  derived and/or modified CDS sequence (AUadapt) from InfluenzaA__AGL09765__HA

SEQ ID NO: 10266 - RNA, 1701 nt, Artificial Sequence
  derived and/or modified CDS sequence (AUadapt) from InfluenzaA__AGL09766__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccagcuccgccugcauccgcgggucgaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccgcaucaccgugagcaccaagcggagccagcaggccgugaucccgaacaucggcucccgcccccggauccgcaacauccccucgcggaucuccaucuacuggaccaucgucaagcccggggacauccugcucaucaacagcacgggcaaccugaucgccccgcgcggguacuucaagauccuguccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccucaagcuggccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacacgaagaucgaccucugguccuacaacgccgagcugcugguggcccucgagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccggaacgggacguacgaccacgacguguaccgcgacgaggcccugaacaaccgcuuccagaucaagggcgucgagcucaagagcggcuacaaggacuggauccuguggaucuccuucgccaucagcugcuuccugcugugcguggcccuccugggguucaucaugugggcgugccagaagggcaacauccggugcaacaucugcaucuga

SEQ ID NO: 10267 - RNA, 1701 nt, Artificial Sequence
  derived and/or modified CDS sequence (AUadapt) from InfluenzaA__AGL09767__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacaacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10268 - RNA, 1701 nt, Artificial Sequence
  derived and/or modified CDS sequence (AUadapt) from InfluenzaA__AGL09769__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcaacuccucguucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugagcaccaagcgcucgcagcaggccgugaucccgaacaucggcucccggccccgcauccggaacauccccagccgcaucuccaucuacuggacgaucgucaagcccggggacauccugcugaucaacucgaccggcaaccucaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccucaaguccacccaggcggccaucgaccagaucaacggcaagcugaaccgccugaucggcaagacgaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 10269 - RNA, 1701 nt, Artificial Sequence; identical to SEQ ID NO: 10103
  derived and/or modified CDS sequence (AUadapt) from InfluenzaA__AGL09770__HA

SEQ ID NO: 10270 - RNA, 1701 nt, Artificial Sequence
  derived and/or modified CDS sequence (AUadapt) from InfluenzaA__AGL09771__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacaucuaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 10271 - RNA, 1701 nt, Artificial Sequence
  derived and/or modified CDS sequence (AUadapt) from InfluenzaA__AGL09772__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacuacguguaccgggacgaggcccucaacaaccgcuuccagaucaaggggguggagcugaaguccggcuacaaggacuggauccuguggaucagcuucgcgaccuccugcuuccuccugugcgucgcccugcucggcuucaucaugugggccugccagaaggggaacauccggugcaacaucugcaucuga

SEQ ID NO: 10272 - RNA, 1701 nt, Artificial Sequence
  derived and/or modified CDS sequence (AUadapt) from InfluenzaA__AGL09773__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccgaggugacccagaacgggaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccggccggaucaccgugucgacgaagcgcucccagcaggccgugaucccgaacaucgggagccggccccgcguccggaacauccccucgcgcguguccaucuacuggaccaucgugaagcccggcgacauccugcucaucaacucgaccggcaaccugaucgccccgcggggguacuucaagauccgcuccggcaagagcuccaucaugcggucggacgcgcccaucgggaagugcaacuccgccugcaucacccccaacggcucgauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgcgggcuucaucgagaacgggugggagggcauggucgacggcugguacggguuccgccaccagaacuccgagggccgggggcaggccgccgaccugaaguccacgcaggccgccaucgaccagaucaacggcaagcugaaccgccucaucgggaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacaugggcaacgggugcuucaagaucuaccacaagugcgacaacgccugcaucggcucgauccgcaacgggaccuacgaccacuacguguaccgggacgaggcccucaacaaccgcuuccagaucaagggcguggagcugaaguccggguacaaggacuggauccuguggaucagcuucgcgaccuccugcuuccuccugugcgucgcccugcucggcuucaucaugugggccugccagaagggcaacauccggugcaacaucugcaucuga

SEQ ID NO: 10273 - RNA, 1701 nt, Artificial Sequence; identical to SEQ ID NO: 10271
  derived and/or modified CDS sequence (AUadapt) from InfluenzaA__AGL09774__HA

SEQ ID NO: 10274 - RNA, 1701 nt, Artificial Sequence; identical to SEQ ID NO: 10113
  derived and/or modified CDS sequence (AUadapt) from InfluenzaA__AGL09775__HA

SEQ ID NO: 10275 - RNA, 1701 nt, Artificial Sequence; identical to SEQ ID NO: 10271
  derived and/or modified CDS sequence (AUadapt) from InfluenzaA__AGL09776__HA

SEQ ID NO: 10276 - RNA, 1701 nt, Artificial Sequence; identical to SEQ ID NO: 10271
  derived and/or modified CDS sequence (AUadapt) from InfluenzaA__AGL09777__HA

SEQ ID NO: 10277 - RNA, 1701 nt, Artificial Sequence
  derived and/or modified CDS sequence (AUadapt) from InfluenzaA__AGL09778__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccgcaucgaggugacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucgucgagcgguccaaggccuacagcaacugcuaccccuacgacgugccggacuacgcgucccugcgcucgcucguggccuccagcggcacccuggaguucaacaacgaguccuucaacugggccggggucacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcgugcaccaccccgggacggacaaggaccagaucuuccuguacgcccagagcuccggccggaucaccgucagcaccaagcgcucgcagcaggccgugaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10278 - RNA, 1701 nt, Artificial Sequence
  derived and/or modified CDS sequence (AUadapt) from InfluenzaA__AGL09779__HA
augaagaccaucaucgcccugucguacauccucugccugguguucgcccagaagcugcccggcaacaacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10279 - RNA, 1701 nt, Artificial Sequence
  derived and/or modified CDS sequence (AUadapt) from InfluenzaA__AGL09780__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucgacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucucgcuguacgcccaguccagcggccggaucaccgugucgaccaagcgcucccagcaggccgugaucccgaacaucggcagccggccccgcauccggaacauccccucccgcaucucgaucuacuggaccaucgucaagcccggggacauccugcucaucaacuccacgggcaaccugaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggcgugccagaagggcaacauccggugcaacaucugcaucuga

SEQ ID NO: 10280 - RNA, 1701 nt, Artificial Sequence; identical to SEQ ID NO: 10238
  derived and/or modified CDS sequence (AUadapt) from InfluenzaA__AGL09781__HA

SEQ ID NO: 10281 - RNA, 1701 nt, Artificial Sequence; identical to SEQ ID NO: 10103
  derived and/or modified CDS sequence (AUadapt) from InfluenzaA__AGL09782__HA

SEQ ID NO: 10282 - RNA, 1701 nt, Artificial Sequence
  derived and/or modified CDS sequence (AUadapt) from InfluenzaA__AGL09783__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccagcgggcgcaucaccguguccaccaagcggucgcagcaggccgucaucccgaacaucggcagccgcccccggauccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgucaagcagucgacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcacccagaaccuggagaaguacguggaggacaccaagaucgaccuguggucguacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 10283 - RNA, 1701 nt, Artificial Sequence; identical to SEQ ID NO: 10113
  derived and/or modified CDS sequence (AUadapt) from InfluenzaA__AGL09785__HA

SEQ ID NO: 10284 - RNA, 1701 nt, Artificial Sequence
  derived and/or modified CDS sequence (AUadapt) from InfluenzaA__AGL09786__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucgacaacgaguccuucaacugggccggggugacgcagaacggcaccagcuccgccugcauccgggggucgaaguccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucucgcuguacgcccaguccagcggccggaucaccgugucgaccaagcgcucccagcaggccgugaucccgaacaucggcagccggccccgcauccggaacauccccucccgcaucucgaucuacuggaccaucgucaagcccggggacauccugcucaucaacuccacgggcaaccugaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucucguucgccaucagcugcuuccuccugugcguggcccugcucggguucaucaugugggcgugccagaagggcaacauccggugcaacaucugcaucuga

SEQ ID NO: 10285 - RNA, 1701 nt, Artificial Sequence
  derived and/or modified CDS sequence (AUadapt) from InfluenzaA__AGL09787__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 10286 - RNA, 1701 nt, Artificial Sequence; identical to SEQ ID NO: 10285
  derived and/or modified CDS sequence (AUadapt) from InfluenzaA__AGL09788__HA

SEQ ID NO: 10287 - RNA, 1701 nt, Artificial Sequence; identical to SEQ ID NO: 10285
  derived and/or modified CDS sequence (AUadapt) from InfluenzaA__AGL09789__HA

SEQ ID NO: 10288 - RNA, 1701 nt, Artificial Sequence; identical to SEQ ID NO: 162
  derived and/or modified CDS sequence (AUadapt) from InfluenzaA__AGL09790__HA

SEQ ID NO: 10289 - RNA, 1701 nt, Artificial Sequence
  derived and/or modified CDS sequence (AUadapt) from InfluenzaA__AGL09791__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacaugacgaugcccaacaacgagcaguucgacaagcucuacaucuggggcgugcaccaccccgggaccgacaaggaccagaucucgcuguacgcgcaguccagcgggcgcaucaccgucucgaccaagcggucccagcaggccgugaucccgaacaucggcagccgcccccggauccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgucaaccggaucaccuacggggccugcccccgcuacgugaagcagucgacgcugaagcucgcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacguggaggacaccaagaucgaccuguggucguacaacgccgagcuccuggucgcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaaggggguggagcugaaguccggcuacaaggacuggauccuguggaucucguucgccaucagcugcuuccuccugugcgucgcccugcucggcuucaucaugugggccugccagaaggggaacauccgcugcaacaucugcaucuga

SEQ ID NO: 10290 - RNA, 1701 nt, Artificial Sequence; identical to SEQ ID NO: 162
  derived and/or modified CDS sequence (AUadapt) from InfluenzaA__AGL09792__HA

SEQ ID NO: 10291 - RNA, 1701 nt, Artificial Sequence
  derived and/or modified CDS sequence (AUadapt) from InfluenzaA__AGL09794__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacacccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 10292 - RNA, 1701 nt, Artificial Sequence; identical to SEQ ID NO: 162
  derived and/or modified CDS sequence (AUadapt) from InfluenzaA__AGL09795__HA

SEQ ID NO: 10293 - RNA, 1701 nt, Artificial Sequence
  derived and/or modified CDS sequence (AUadapt) from InfluenzaA__AGL09797__HA
augaagaccaucaucgcccugucguacauccucugccugguguucucccagaagcugcccggcaacgacaacagcaccgccacgcucugccuggggcaccacgcggucccgaacggcaccaucgugaagaccaucaccaacgaccgcaucgaggugacgaacgccaccgagcugguccagaacuccucgaucggggagaucugcgacagcccccaccagauccucgacggcgagaacugcacccugaucgacgcccugcucggggacccccagugcgacggcuuccagaacaagaagugggaccuguucguggagcggucgaaggccuacuccaacugcuaccccuacgacgugccggacuacgccagccugcgcucccucgucgcgucguccggcacccuggaguucaacaacgagagcuucaacugggccggggugacgcagaacggcaccuccagcgccugcauccggggguccaacucguccuucuucagccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccucgggccggaucaccgugagcaccaagcgcucccagcaggccgugaucccgaacaucggcucgcggccccgcauccggaacauccccucccgcaucagcaucuacuggaccaucgucaagcccggggacauccugcucaucaacuccacgggcaaccugaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgccugcccccgguacgugaagcagucgacccugaagcucgcgacggggaugcgcaacguccccgagaagcagacccggggcaucuucggggccaucgccggcuucaucgagaacggcugggaggggaugguggacggcugguacggguuccgccaccagaacuccgagggccgggggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 10294 - RNA, 1701 nt, Artificial Sequence
  derived and/or modified CDS sequence (AUadapt) from InfluenzaA__AGL09798__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccagcggcacccuggaguucaacaacgaguccuucaacugggccggggugacgcagaacggcaccucguccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacuucgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacuacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 10295 - RNA, 1701 nt, Artificial Sequence; identical to SEQ ID NO: 10293
  derived and/or modified CDS sequence (AUadapt) from InfluenzaA__AGL09799__HA

SEQ ID NO: 10296 - RNA, 1701 nt, Artificial Sequence; identical to SEQ ID NO: 162
  derived and/or modified CDS sequence (AUadapt) from InfluenzaA__AGL09800__HA

SEQ ID NO: 10297 - RNA, 1701 nt, Artificial Sequence; identical to SEQ ID NO: 10103
  derived and/or modified CDS sequence (AUadapt) from InfluenzaA__AGL09801__HA

SEQ ID NO: 10298 - RNA, 1701 nt, Artificial Sequence; identical to SEQ ID NO: 10103
  derived and/or modified CDS sequence (AUadapt) from InfluenzaA__AGL09802__HA

SEQ ID NO: 10299 - RNA, 1701 nt, Artificial Sequence
  derived and/or modified CDS sequence (AUadapt) from InfluenzaA__AGL09803__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcagcggacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 10300 - RNA, 1701 nt, Artificial Sequence; identical to SEQ ID NO: 10136
  derived and/or modified CDS sequence (AUadapt) from InfluenzaA__AGL09804__HA

SEQ ID NO: 10301 - RNA, 1701 nt, Artificial Sequence; identical to SEQ ID NO: 10242
  derived and/or modified CDS sequence (AUadapt) from InfluenzaA__AGL09805__HA

SEQ ID NO: 10302 - RNA, 1701 nt, Artificial Sequence; identical to SEQ ID NO: 10271
  derived and/or modified CDS sequence (AUadapt) from InfluenzaA__AGL09806__HA

SEQ ID NO: 10303 - RNA, 1701 nt, Artificial Sequence; identical to SEQ ID NO: 10242
  derived and/or modified CDS sequence (AUadapt) from InfluenzaA__AGL09807__HA

SEQ ID NO: 10304 - RNA, 1701 nt, Artificial Sequence
  derived and/or modified CDS sequence (AUadapt) from InfluenzaA__AGL09808__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacgucggcucccgcccccggauccgcaacauccccagccggaucuccaucuacuggaccaucgugaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgucaagcaguccacccugaagcucgccacggggaugcggaacgugcccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 10305 - RNA, 1701 nt, Artificial Sequence
  derived and/or modified CDS sequence (AUadapt) from InfluenzaA__AGL09809__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcacgccggggcgaagggcuucuacaagaaccugaucuggcuggugaagaaggggaacagcuaccccaagcucuccaucucguacaucaacgacaagggcaaggaggugcugguccuguggggcauccaccaccccuccaccacggccgaccagcagucgcucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgccaucuacuccaccgcggccucgucccugguccugguggugagccucggcgccaucuccuucuggaugugcucgaacgggagccugcagugccggaucugcaucuga

SEQ ID NO: 10306 - RNA, 1701 nt, Artificial Sequence
  derived and/or modified CDS sequence (AUadapt) from InfluenzaA__AGL09810__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucuccaacgagucguucaacuggacgggggugacccagaacggcaccuccagcgccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccgugucgaccaagcggucccagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacgggacgugcccccgcuacgugaagcagagcacccugaagcucgccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagucgacgcaggccgcgaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcauggggucgauccggaacggcaccuacgaccacgacguguaccgcgacgaggcgcucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 10307 - RNA, 1701 nt, Artificial Sequence; identical to SEQ ID NO: 10103
  derived and/or modified CDS sequence (AUadapt) from InfluenzaA__AGL09811__HA

SEQ ID NO: 10308 - RNA, 1701 nt, Artificial Sequence
  derived and/or modified CDS sequence (AUadapt) from InfluenzaA__AGL09812__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccaggacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10309 - RNA, 1701 nt, Artificial Sequence; identical to SEQ ID NO: 10080
  derived and/or modified CDS sequence (AUadapt) from InfluenzaA__AGL09813__HA

SEQ ID NO: 10310 - RNA, 1701 nt, Artificial Sequence; identical to SEQ ID NO: 10128
  derived and/or modified CDS sequence (AUadapt) from InfluenzaA__AGL09814__HA

SEQ ID NO: 10311 - RNA, 1701 nt, Artificial Sequence
  derived and/or modified CDS sequence (AUadapt) from InfluenzaA__AGL09815__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggucgcagcaggccgugaucccgaacaucggcucccgcccccggauccgcagcauccccucccggaucucgaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 10312 - RNA, 1701 nt, Artificial Sequence; identical to SEQ ID NO: 10128
  derived and/or modified CDS sequence (AUadapt) from InfluenzaA__AGL09816__HA

SEQ ID NO: 10313 - RNA, 1701 nt, Artificial Sequence
  derived and/or modified CDS sequence (AUadapt) from InfluenzaA__AGL09817__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacucggaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaggccgugaucccgaacaucggcucccggccccgcguccggaacauccccagccgcguguccaucuacuggaccaucgugaagcccggcgacauccugcucaucaacucgaccgggaaccugaucgccccgcggggcuacuucaagauccgcuccgggaaguccuccaucaugcggucggacgcccccaucggcaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 10314 - RNA, 1701 nt, Artificial Sequence; identical to SEQ ID NO: 10128
  derived and/or modified CDS sequence (AUadapt) from InfluenzaA__AGL09818__HA

SEQ ID NO: 10315 - RNA, 1701 nt, Artificial Sequence; identical to SEQ ID NO: 162
  derived and/or modified CDS sequence (AUadapt) from InfluenzaA__AGL09819__HA

SEQ ID NO: 10316 - RNA, 1701 nt, Artificial Sequence
  derived and/or modified CDS sequence (AUadapt) from InfluenzaA__AGL09820__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgcgggagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggucgcagcaggccgugaucccgaacaucggcucccgcccccggauccgcaacauccccagccggaucuccaucuacuggacgaucgucaagcccggggacauccugcucaucaacucgaccggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagacgaacgagaaguuccaccagaucgagaaggaguucagcgagaucgaggggcgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcguggagcucaagagcggcuacaaggacuggauccuguggaucuccuucgccaucagcugcuuccugcugugcgucgcccugcucggguucaucaugugggccugccagaagggcaacauccgcugcaacaucugcaucuga

SEQ ID NO: 10317 - RNA, 1701 nt, Artificial Sequence
  derived and/or modified CDS sequence (AUadapt) from InfluenzaA__AGL09821__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggaucgagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 10318 - RNA, 1701 nt, Artificial Sequence; identical to SEQ ID NO: 10242
  derived and/or modified CDS sequence (AUadapt) from InfluenzaA__AGL09822__HA

SEQ ID NO: 10319 - RNA, 1701 nt, Artificial Sequence; identical to SEQ ID NO: 10285
  derived and/or modified CDS sequence (AUadapt) from InfluenzaA__AGL09823__HA

SEQ ID NO: 10320 - RNA, 1701 nt, Artificial Sequence
  derived and/or modified CDS sequence (AUadapt) from InfluenzaA__AGL09824__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcaccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 10321 - RNA, 1701 nt, Artificial Sequence; identical to SEQ ID NO: 162
  derived and/or modified CDS sequence (AUadapt) from InfluenzaA__AGL09825__HA

SEQ ID NO: 10322 - RNA, 1701 nt, Artificial Sequence; identical to SEQ ID NO: 10320
  derived and/or modified CDS sequence (AUadapt) from InfluenzaA__AGL09826__HA

SEQ ID NO: 10323 - RNA, 1701 nt, Artificial Sequence; identical to SEQ ID NO: 10113
  derived and/or modified CDS sequence (AUadapt) from InfluenzaA__AGL09827__HA

SEQ ID NO: 10324 - RNA, 1701 nt, Artificial Sequence
  derived and/or modified CDS sequence (AUadapt) from InfluenzaA__AGL09828__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugucgaccaagcggagccagcaggccgugaucccgaacaucggcucccgcccccggauccgcaacauccccucgcggaucuccaucuacuggaccaucgucaagcccggggacauccugcucaucaacagcacgggcaaccugaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguaccggcaccagaacagcgagggccgcgggcaggccgcggaccugaaguccacccaggccgccaucgaccagaucaacggcaagcugaaccggcucaucggcaagaccaacgagaaguuccaccagaucgagaaggaguucucggagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagucgggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 10325 - RNA, 1701 nt, Artificial Sequence
  derived and/or modified CDS sequence (AUadapt) from InfluenzaA__AGL09829__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccuggaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10326 - RNA, 1701 nt, Artificial Sequence; identical to SEQ ID NO: 10128
  derived and/or modified CDS sequence (AUadapt) from InfluenzaA__AGL09830__HA

SEQ ID NO: 10327 - RNA, 1701 nt, Artificial Sequence; identical to SEQ ID NO: 10238
  derived and/or modified CDS sequence (AUadapt) from InfluenzaA__AGL09831__HA

SEQ ID NO: 10328 - RNA, 1701 nt, Artificial Sequence
  derived and/or modified CDS sequence (AUadapt) from InfluenzaA__AGL09832__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccacagcaacuucaaguaccccgcccugaacgugacgaugcccaacaacgagcaguucgacaagcuguacaucuggggcguccaccaccccgggaccgacaaggaccagaucuuccucuacgcgcaguccucggggcgcaucaccgugagcaccaagcggucccagcaggccgugaucccgaacaucggcucgcgcccccggauccgcaacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcagagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggaccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10329 - RNA, 1701 nt, Artificial Sequence; identical to SEQ ID NO: 162
  derived and/or modified CDS sequence (AUadapt) from InfluenzaA__AGL09833__HA

SEQ ID NO: 10330 - RNA, 1701 nt, Artificial Sequence
  derived and/or modified CDS sequence (AUadapt) from InfluenzaA__AGL09881__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcgccucguccgcgugcauccgggggagcaacuccucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccagagcuccggccggaucacggugagcaccaagcgcucgcagcaggccgugaucccgaacaucggcucccggccccgcauccggaacauccccagccgcaucuccaucuacuggaccaucgucaagcccggggacauccugcucaucaacucgaccggcaaccugaucgccccgcggggguacuucaagauccgcuccggcaagagcuccaucaugcggucggacgcgcccaucggcaagugcaaguccgagugcaucacgcccaacgggagcauccccaacgacaagccguuccagaacgugaaccgcaucaccuacggcgccugcccccgguacgugaagcaguccacccugaagcucgccaccgggaugcgcaacguccccgagaagcagacgcggggcaucuucggggccaucgccggcuucaucgagaacggcugggaggggaugguggacggcugguacggguuccgccaccagaacucggagggccgggggcaggcggccgaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacaccaagaucgaccugugguccuacaacgccgagcuccugguggcgcuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcgcugcucggguucaucaugugggccugccagaagggcaacauccggugcaacaucugcaucuga

SEQ ID NO: 10331 - RNA, 1701 nt, Artificial Sequence; identical to SEQ ID NO: 10103
  derived and/or modified CDS sequence (AUadapt) from InfluenzaA__AGL09882__HA

SEQ ID NO: 10332 - RNA, 1701 nt, Artificial Sequence; identical to SEQ ID NO: 10080
  derived and/or modified CDS sequence (AUadapt) from InfluenzaA__AGL09883__HA

SEQ ID NO: 10333 - RNA, 1701 nt, Artificial Sequence; identical to SEQ ID NO: 10080
  derived and/or modified CDS sequence (AUadapt) from InfluenzaA__AGL09884__HA

SEQ ID NO: 10334 - RNA, 1683 nt, Artificial Sequence; identical to SEQ ID NO: 86
  derived and/or modified CDS sequence (AUadapt) from InfluenzaA__AGL44438__HA

SEQ ID NO: 10335 - RNA, 1701 nt, Artificial Sequence
  derived and/or modified CDS sequence (AUadapt) from InfluenzaA__AGN69267__HA
augaaggccauccuggugguccuccuguacaccuucaccacgggcaacgccgacacccugugcaucggguaccacgcgaacaacucgaccgacaccguggacacggugcucgagaagaacgucaccgugacccacuccgugaaccugcuggaggaccgccacaacggcaagcucugcaagcugcgcggggucgcgccccugcaccucggcaagugcaacaucgccggguggcugcugggcaacccggagugcgagcuccuguucaccgccucguccuggagcuacaucguggagacguccaacucggacaacgggaccugcuaccccggggacuucaucaacuacgaggagcugcgggagcagcucuccagcguguccucguucgagcgguucgagaucuuccccaaggccuccagcuggcccaaccacgagaccaaccgcggcgucaccgccgccugcccguacgccggggccaacuccuucuaccggaaccugaucuggcuggugaagaagggcaacucguaccccaagcucuccaagucguacaucaacaacaaggagaaggaggugcugguccugugggggauccaccacccgcccacguccaccgaccagcagagccucuaccagaacgcggacgccuacguguucgugggcuccucgaaguacagcaagaaguucaagcccgagaucgccacccgccccaagguccggggccaggccgggcgcaugaacuacuacuggacccugguggagcccggcgacacgaucaccuucgaggccaccgggaaccugguggucccccgguacgcguucgccaugaagcgcggcuccggcucggggaucaucaucuccgacaccccggugcacgacugcaacacgaccugccagacccccaagggcgccaucaacaccagccuccccuuccagaacauccaccccgugacgaucggggagugcccgaaguacgucaaguccaccaagcugcggauggccaccggccugcgcaacauccccucgauccagucccggggccucuucggcgccaucgcgggcuucaucgagggcggguggaccgggaugaucgacggcugguacggguaccaccaccagaacgagcagggcucgggcuacgccgccgaccgcaaguccacgcagaacgccaucgacgggaucaccaacaaggugaacagcgugaucgagaagaugaacacccaguucaccgccgucggcaaggaguucaaccaccuggagaagcggaucgagaaccugaacaagaagguggacgacgggcuccuggacgucuggacguacaacgcggagcugcucgugcugcuggagaacgagcgcacccucgacuaccacgacuccaacgugaagaaccuguacgagaagguccggucgcagcugaagaacaacgccaaggagaucggcaacgggugcuucgaguucuaccacaagugcgacgacacgugcauggaguccgugaagaacggcaccuacgacuaccccaaguacagcgaggaggccaagcucaaccgcgaggagaucgacggcgugaagcuggaguccacccggaucuaccagauccuggccaucuacucgaccgucgccuccagccucgugcugcuggugucccucggggcgaucucguucuggaugugcagcaacggcucccugcagugccgcaucugcaucuga

SEQ ID NO: 10336 - RNA, 1701 nt, Artificial Sequence
  derived and/or modified CDS sequence (AUadapt) from InfluenzaA__AGN69278__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggaccgccacaacgggaagcucugcaagcugcggggcgucgcgccccugcaccucgggaagugcaacaucgccggcuggcugcuggggaacccggagugcgagcuccuguucaccgccucguccuggagcuacaucguggagacguccaacucggacaacgggaccugcuaccccggcgacuucaucaacuacgaggagcugcgcgagcagcucuccucgguguccagcuucgagcgguucgagaucuuccccaaggccuccucguggcccaaccacgagccgaaccgcggcgucaccgccgccugccccuacgccggcgcgaacuccuucuaccggaaccugaucuggcuggugaagaaggggaacagcuaccccaagcucuccaagucguacaucaacaacaaggagaaggaggugcugguccuguggggcauccaccacccgcccaccuccacggaccagcagucgcucuaccagaacgccgacgccuacguguucgugggguccagcaaguacaacaagaaguucaagcccgagaucgccacccgccccaagguccggggccaggccggccgcaugaacuacuacuggacccugguggagcccggggacaccaucacguucgaggcgaccggcaaccugguggucccgcgguacgccuucgccaugaagcgcgggucgggcuccggcaucaucaucagcgacacccccgugcacgacugcaacaccacgugccagacccccaagggggccaucaacaccucccuccccuuccagaacauccacccggugaccaucggcgagugccccaaguacgucaagucgacgaagcugcggauggccaccgggcugcgcaacauccccuccauccagucgcggggccucuucggggcgaucgccggcuucaucgagggcggguggaccggcaugaucgacgggugguacggcuaccaccaccagaacgagcagggguccggcuacgccgccgaccgcaagagcacccagaacgccaucgacggcaucacgaacaaggugaacuccgugaucgagaagaugaacacccaguucaccgcggucgggaaggaguucaaccaccuggagaagcggaucgagaaccugaacaagaagguggacgacggccuccuggacgucuggaccuacaacgccgagcugcucgugcugcuggagaacgagcgcacgcucgacuaccacgacucgaacgugaagaaccuguacgagaagguccggucccagcugaagaacaacgccaaggagaucgggaacggcugcuucgaguucuaccacaagugcgacgacacgugcauggagagcgugaagaacgggaccuacgacuaccccaaguacuccgaggaggccaagcucaaccgcgaggagaucgacggcgugaagcuggagucgacccggaucuaccagauccuggccaucuacuccaccgucgcgucgucccucgugcugcuggugagccucggcgccaucuccuucuggaugugcucgaacgggagccugcagugccgcaucugcaucuga

SEQ ID NO: 10337 - RNA, 1701 nt, Artificial Sequence
  derived and/or modified CDS sequence (AUadapt) from InfluenzaA__AGN69302__HA
auggaggccaagcuguucguccucuucugcgccuucaccgcgcugaaggccgacaccaucugcgugggcuaccacgccaacaacucgacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacucgugguccuacaucaucgagaccagcaacuccaaggacggcgcgugcuaccccggcgaguucgccgacuacgaggagcugaaggagcagcugagcaccgucuccucguucgagcgcuucgagaucuuccccaaggccacguccuggcccaaccacgacaccacccgggggaccacgguggccugcagccacuccggcgcgaacucguucuaccgcaaccuccuguggaucgugaagaaggggaacuccuacccgaagcugagcaaguccuacaccaacaacaagggcaaggagguccucgugaucuggggcgugcaccacccgcccaccgacagcgaccagcagacccuguaccagaacaaccacacguacgucuccguggggucgagcaaguacuacaagcgguucacccccgagaucguggcccgccccaagguccgggagcaggccggccgcaugaacuacuacuggacccugcucgaccagggggacaccaucacguucgaggccaccggcaaccugaucgcccccuggcacgcguucgcccugaagaagggguccucguccggcaucaugaugagcgacgcccaggugcacaacugcaccaccaagugccagacgccccacggcgcccucaaggggaaccugcccuuccagaacgugcacccggucaccaucggcgagugccccaaguacgugaaguccacccagcugcggauggccaccgggcuccgcaacauccccagcauccagucccggggccuguucggggcgaucgccggcuucaucgagggcggguggacgggcaugguggacgggugguacggcuaccaccaccagaacgagcaggggucgggcuacgccgccgaccagaaguccacccagaucgccaucgacggcaucagcaacaaggucaacuccgugaucgagaagaugaacauccaguucaccucgguggggaaggaguucaacucccuggagaagcgcauggagaaccucaacaagaaggucgacgacggcuuccuggacguguggaccuacaacgcggagcugcucauccugcuggagaacgagcggacgcucgacuuccacgaccugaacgucaagaaccuguacgagaaggucaagagccagcuccgcaacaacgccaaggagaucgggaacggcugcuucgaguucuaccacaagugcgacaacgagugcauggaguccgugaagaacgggaccuacaacuaccccaaguacagcgaggaguccaagcugaaccgggaggagaucgacggcgugaagcuggagucgaugggcauccaccagauccucgccaucuacuccaccguggccagcucgcuggugcugcucgucucccugggggccaucagcuucuggaugugcuccaacggcagccugcagugccgcgugugcaucuga

SEQ ID NO: 10338 - RNA, 1701 nt, Artificial Sequence; identical to SEQ ID NO: 10337
  derived and/or modified CDS sequence (AUadapt) from InfluenzaA__AGN69314__HA

SEQ ID NO: 10339 - RNA, 1701 nt, Artificial Sequence; identical to SEQ ID NO: 10337
  derived and/or modified CDS sequence (AUadapt) from InfluenzaA__AGN69326__HA

SEQ ID NO: 10340 - RNA, 1701 nt, Artificial Sequence
  derived and/or modified CDS sequence (AUadapt) from InfluenzaA__AGN69338__HA
auggaggccaagcuguucguccucuucugcgccuucaccgcgcugaaggccgacaccaucugcgugggcuaccacgccaacaacucgacggacaccguggacaccauccuggagaagaacgugaccgucacgcacuccgugaaccuccuggagaacagccacaacgggaagcugugcucccucaacggcaagaucccccugcagcuggggaacugcaacguggccggcuggauccucgggaacccgaagugcgaccugcugcucaccgccaacucgugguccuacaucaucgagaccagcaacuccaagaacggcgcgugcuaccccggcgaguucgccgacuacgaggagcugaaggagcagcugucgaccgucuccagcuucgagcgcuucgagaucuuccccaaggccacguccuggcccaaccacgacaccacccgggggaccacgguggccugcucgcacuccggcgcgaacagcuucuaccgcaaccuccuguggaucgugaagaaggggaacuccuacccgaagcugucgaaguccuacaccaacaacaagggcaaggagguccucgugaucuggggcgugcaccacccgcccaccgacagcgaccagcagacccuguaccagaacaaccacacguacgucuccguggggucgagcaaguacuacaagcgguucacccccgagaucguggcccgccccaagguccgggagcaggccggccgcaugaacuacuacuggacccugcuccaccagggggacaccaucacguucgaggccaccggcaaccugaucgcccccuggcacgcguucgcccugaacgagggguccucguccggcaucaugcggagcgacgcccaggugcacaacugcaccaccaagugccagacgccccacggcgcccucaaggggaaccugcccuuccagaacgugcacccggucaccaucggcgagugccccaaguacgugaaguccacccagcugcgcauggccaccgggcuccggaacauccccucgauccagucccgcggccuguucggggcgaucgccggcuucaucgagggcggguggacgggcaugguggacgggugguacggcuaccaccaccggaacgagcaggggagcggcuacgccgccgaccagaaguccacccagaucgccaucgacggcaucucgaacaaggucaacuccgugaucgagaagaugaacauccaguucaccagcguggggaaggagugcaacucccuggagaagcgcauggagaaccucaacaagaaggucgacgacggcuuccuggacguguggaccuacaacgcggagcugcucauccugcuggagaacgagcggacgcucgacuuccacgaccugaacgucaagaaccuguacgagaaggucaagucgcagcuccgcaacaacgccaaggagaucgggaacggcugcuucgaguucuaccacaagugcgacaacgagugcauggaguccgugaagaacgggaccuacaacuaccccaaguacagcgaggaguccaagcugaaccgggaggagaucgacggcgugaagcuggagucgaugggcauccaccagauccucgccaucuacuccaccguggccagcucgcuggugcugcucgucucccugggggccaucagcuucuggaugugcuccaacggcagccugcagugccgcgugugcaucuga

SEQ ID NO: 10341 - RNA, 1701 nt, Artificial Sequence
  derived and/or modified CDS sequence (AUadapt) from InfluenzaA__AGO00265__HA
augaaggcccgccugcucgugcugcugugcgccaucgcggccaccgacgccgacaccaucugcaucggcuaccacgccaacaacucgacggacaccgucgacaccauccucgagaagaacgugaccgugacgcacuccgucaaccugcuggaggacagccacaacgggaagcucugccggcugaagggcaucgcgccccugcagcucgggaagugcaacaucgccggcuggauccuggggaacccggagugcgagucccugcucucggagcgcuccuggagcuacaucguggagacccccaacuccgagaacgggaccugcuaccccggcgacuucaucgacuacgaggagcugcgggagcagcugucguccgugaccagcuucgagcgcuucgagaucuuccccaaggagacguccuggccgaagcacaacaccaccaagggggucaccgccgccugcucgcacgccggcaagugcuccuucuaccggaaccuccuguggcugacggagaaggacgggagcuaccccaaccucaacaacuccuacgugaacaagaagggcaaggaggugcugguccuguggggcgugcaccaccccucgaacaucaaggaccagcagacccucuaccagaaggagaacgcguacguguccgucgugagcuccaacuacaaccgccgguucacccccgagaucgccgagcgcccgaaggugcggggccaggccggccgcaugaacuacuacuggacccugcuggagcccggggacacgaucaucuucgaggccaacggcaaccucaucgcccccugguacgcguucgcccugucgcggggguucggcagcggcaucaucaccuccaacgccucgaugcacgagugcaacaccaagugccagacgccccagggggccaucaacuccagccugccguuccagaacauccaccccgucaccaucggcgagugccccaaguacgugcgcuccaccaagcuccggauggugaccgggcugcgcaacauccccucgauccagucccggggccuguucggggccaucgcgggcuucaucgagggcggguggaccggcaugaucgacgggugguacggcuaccaccaccagaacgagcaggggagcggcuacgccgccgaccagaaguccacgcagaacgccaucaacggcaucaccaacaaggucaacucggugaucgagaagaugaacacccaguucaccgccguggggaaggaguucaacaaccucgagaagcgcauggagaaccugaacaagaaggucgacgacggcuuccuggacaucuggacguacaacgcggagcuccuggugcugcucgagaacgagcggacccuggacuuccacgacuccaacgugaagaaccuguacgagaaggucaagagccagcuccgcaacaacgccaaggagaucgggaacggcugcuucgaguucuaccacaagugcaacaacgagugcauggaguccgugaagaacgggaccuacgacuacccgaaguacucggaggaguccaagcugaaccgggagaagaucgacggcgucaagcuggagagcaugggcguguaccagauccucgccaucuacuccaccguggccucgucccugguccugcucgugagccugggggccaucucguucuggaugugcuccaacggcagccugcagugccgcaucugcaucuga

SEQ ID NO: 10342 - RNA, 1701 nt, Artificial Sequence
  derived and/or modified CDS sequence (AUadapt) from InfluenzaA__AGO00277__HA
augaaggccaagcugcucauccugcugugcgcccucucggcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagucgcuccuguccaagcggagcugguccuacaucgccgagacccccaacucggagaacgggaccugcuaccccggcgacuucgccgacuacgaggagcugcgcgagcagcucuccagcguguccucguucgagcgguucgagaucuuccccaaggagcgcuccuggccgaaccacaacaucaacaucggcgugaccgccgccugcagccacgcgggcaaguccucguucuacaagaaccugcuguggcucacggagaaggacggguccuaccccaaccugaacaagagcuacgucaacaagaaggagaaggaggugcuggugcucuggggcguccaccaccccuccaacaucgagaaccagaagacccuguaccggaaggagaacgccuacgugucgguggucagcuccaacuacaaccgccgguucacccccgagaucgccgagcgcccgaaggugcgggggcaggccggccgcaugaacuacuacuggacccugcucgagcccggcgacacgaucaucuucgaggccaacgggaaccugaucgcgcccugguacgccuucgcccugucgcggggccucggguccggcaucaucaccagcaacgccuccauggacgagugcgacaccaagugccagacgccccagggcgccaucaacucgucccugccguuccagaacauccaccccuucaccaucggggagugccccaaguacgugcgcagcaccaagcugcggauggucaccggccuccgcaacauccccuccauccagucgcgggggcuguucggcgcgaucgccggguucaucgagggcggcugggccgggaugaucgacggcugguacggguaccaccaccagaacgagcagggcuccggguacgccgccgaccagaaguccacccagaacgcgaucaacggcaucacgaacaaggugaacagcgugaucgagaagaugaacacccaguucaccgccgucggcaaggaguucaacaagcuggagaagcgcauggagaaccucaacaagaagguggacgacggguuccuggacaucuggaccuacaacgccgagcugcucgugcugcuggagaacgagcggacgcucgacuuccacgacucgaacgucaagaaccuguacgagaaggugaagaaccagcugcgcaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggggucaagcuggagucgaugggcguguaccagauccuggccaucuacuccaccgucgcgagcucgcucgugcugcuggugucccucggcgccaucagcuucuggaugugcuccaacgggagccugcagugccgcaucugcaucuga

SEQ ID NO: 10343 - RNA, 1701 nt, Artificial Sequence; identical to SEQ ID NO: 1879
  derived and/or modified CDS sequence (AUadapt) from InfluenzaA__AGO00289__HA

SEQ ID NO: 10344 - RNA, 1698 nt, Artificial Sequence
  derived and/or modified CDS sequence (AUadapt) from InfluenzaA__AGO00301__HA
augaaggccaagcugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccgccugaagggcaaggcgccccuccagcuggggaacugcaacaucgccggcugggugcuggggaacccggagugcgagucgcuccuguccaaccggagcugguccuacaucgccgagacccccaacucggagaacgggaccugcuaccccggcgacuucgccgacuacgaggagcugcgcgagcagcucuccucgguguccagcuucgagcgguucgagaucuuccccaaggagcgcuccuggccgaaccacaccacgcggggcgucaccgccgccugcccccacgcgcgcaagucguccuucuacaagaaccugguguggcugaccgaggccaacggcucguaccccaaccucucccggagcuacgugaacaaccaggagaaggagguccuggugcuguggggcgugcaccaccccuccaacaucgaggagcagcgcgcccucuaccggaaggacaacgccuacgucucgguggugucguccaacuacaaccgccgguucaccccggagaucgccaagcgccccaagguccgggaccagagcgggcgcaugaacuacuacuggacgcugcuggagcccggggacaccaucaucuucgaggcgaccggcaaccucaucgcccccugguacgccuucgcccugucccggggcccggggucgggcaucaucaccuccaacgcgccccuggacgagugcgacacgaagugccagacgccccagggggccaucaacucgucccuccccuuccagaacauccacccggugaccaucggcgagugccccaaguacgugcgcagcaccaagcugcggauggucaccggccugcgcaacauccccuccgugcagucgcggggccucuucggggccaucgccggguucaucgagggcggguggaccggcaugauggacggcugguacggguaccaccaccagaacgagcagggcuccggguacgccgccgaccagaaguccacccagaacgcgaucaacggcaucaccaacaaggugaacucggucaucgagaagaugaacacgcaguucaccgccguggggaaggaguucaacaagcuggagaagcgcauggagaaccugaacaagaagguggacgacggcuucauggacaucuggaccuacaacgccgagcuccugguccugcucgagaacgagcggacccuggacuuccacgacagcaacgugaagaaccuguacgagaaggucaagaaccagcuccgcaacaacgccaaggagcugggcaacgggugcuucgaguucuaccacaagugcgacaacgagugcauggaguccgugaagaacggcacguacgacuaccccaaguacucggaggaguccaagcugaaccgcgagaagaucgacggggugaagcucgagucgaugggcgucuaccggauccuggccaucuacuccaccguggcgagcucgcuggugcuccuggucucccugggggccaucucguucuggaugugcuccaacggcagccuccagugccgcaucugcaucuga

SEQ ID NO: 10345 - RNA, 1701 nt, Artificial Sequence
  derived and/or modified CDS sequence (AUadapt) from InfluenzaA__AGO00313__HA
augaagaccaucaucgcccugucguacaucuucugccaggugcucgcccagaaccugcccggcaacgacaacuccaccgcgacgcugugccucgggcaccacgccgucccgaacggcacccuggugaagaccaucaccaacgaccagaucgaggugacgaacgccaccgagcugguccagucguccagcaccgggcgcaucugcgacucgccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccucguccggcacgcuggaguucaucaacgagggguucaacuggaccggcgugacccagaacgggggcagcuacgccugcaagcgcgggcccgacaacuccuucuucucgcggcugaacuggcucuacaaguccgagagcaccuaccccgugcugaacgucacgaugcccaacaacgacaacuucgacaagcuguacaucuggggcgugcaccacccguccaccgacaaggagcagaccaaccucuacgugcaggccucgggccgcgucaccguguccacgaagcggagccagcagaccaucauccccaacguggggucgcgccccuggguccggggccuguccagcgggaucuccaucuacuggaccaucgugaagcccggcgacauccugcucaucaacucgaacggcaaccugaucgcgccgcgcggguacuucaagauccggaccggcaaguccagcaucaugcgcuccgacgcccccaucgggacgugcucguccgagugcaucacccccaacggcagcauccccaacgacaagccguuccagaacgugaacaagaucaccuacggggccugccccaaguacgucaagcagaacacccugaagcucgccacgggcaugcggaacgugcccgagaagcagacccgcggcaucuucggggccaucgcgggcuucaucgagaacgggugggagggcaugaucgacgggugguacggcuuccggcaccagaacuccgagggcaccgggcaggccgccgaccucaagucgacccaggccgccaucgaccagaucaacggcaagcugaaccgcgugaucgagaagacgaacgagaaguuccaccagaucgagaaggaguucuccgaggucgaggggcggauccaggaccucgagaaguacguggaggacaccaagaucgaccuguggagcuacaacgcggagcugcucguggcccuggagaaccagcacaccaucgaccugaccgacuccgagaugaacaagcuguucgagaagacgcgccggcagcugcgcgagaacgccgaggacaugggcaacgggugcuucaagaucuaccacaagugcgacaacgccugcaucggcucgauccggaacggcaccuacgaccacgacgucuaccgcgacgaggcccugaacaaccgcuuccagaucaaggggguggagcucaaguccggcuacaaggacuggauccuguggaucagcuucgcgaucuccugcuuccugcucugcgucgugcugcugggguucaucaugugggccugccagaagggcaacauccggugcaacaucugcaucuga

SEQ ID NO: 10346 - RNA, 1704 nt, Artificial Sequence; identical to SEQ ID NO: 9342
  derived and/or modified CDS sequence (AUadapt) from InfluenzaA__AGO00325__HA

SEQ ID NO: 10347 - RNA, 1698 nt, Artificial Sequence
  derived and/or modified CDS sequence (AUadapt) from InfluenzaA__AGO00337__HA
augaaggccaaccugcucgugcugcugucggcccucgcggccgccgacgccgacaccaucugcaucggcuaccacgccaacaacuccaccgacacggucgacaccgugcuggagaagaacgugaccgucacccacucggugaaccugcucgaggacucccacaacgggaagcugugccgccugaagggcaucgcgccccuccagcuggggaagugcaacaucgccggcuggcugcucgggaacccggagugcgacccccugcugcccgugcggagcugguccuacaucgucgagacgcccaacucggagaacggcaucugcuacccgggcgacuucaucgacuacgaggagcuccgcgagcagcuguccagcguguccucguucgagcgguucgagaucuuccccaaggaguccagcuggcccaaccacaacaccaacggggugaccgccgccugcucccacgagggcaagucguccuucuaccgcaaccugcucuggcugaccgagaaggaggggagcuaccccaagcugaagaacuccuacgucaacaagaagggcaaggaggugcucgugcugugggggauccaccacccgcccaacucgaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucggguccggcaucaucacgucgaacgccuccaugcacgagugcaacaccaagugccagacgccccugggcgccaucaacagcucccugcccuaccagaacgugcacccggugaccaucggggagugccccaaguacguccggucggccaagcuccgcauggugaccggccugcggaacacccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucacgaacaaggugaacaccgucaucgagaagaugaacauccaguucaccgcggugggcaaggaguucaacaagcucgagaagcggauggagaaccugaacaagaagguggacgacggguuccuggacaucuggaccuacaacgccgagcuccugguccugcucgagaacgagcgcacgcuggacuuccacgacucgaacgugaagaaccuguacgagaaggucaagagccagcucaagaacaacgccaaggagaucggcaacgggugcuucgaguucuaccacaagugcgacaacgagugcauggaguccgugcggaacggcaccuacgacuaccccaaguacucggaggaguccaagcugaaccgcgagaagguggacggggucaagcuggagagcaugggcaucuaccagauccucgccaucuacuccaccguggccucgucccuggugcugcucgucagccugggcgcgaucucguucuggaugugcuccaacgggagccugcagugccggaucugcaucuga

SEQ ID NO: 10348 - RNA, 1698 nt, Artificial Sequence; identical to SEQ ID NO: 3523
  derived and/or modified CDS sequence (AUadapt) from InfluenzaA__AGO00349__HA

SEQ ID NO: 10349 - RNA, 1698 nt, Artificial Sequence
  derived and/or modified CDS sequence (AUadapt) from InfluenzaA__AGO00373__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccgaccacaacaccaacggggugaccgccgccugcucgcacgagggcaaguccagcuucuaccgcaaccugcucuggcugaccgagaaggaguccucguaccccaagcugaagaacuccuacgucaacaagaaggggaaggaggugcucgugcuguggggcauccaccacccgcccaacagcaaggagcagcagaaccuguaccagaacgagaacgcguacgucuccguggugacgucgaacuacaaccggcgcuucacccccgagaucgccgagcggcccaagguccgcgaccaggccgggcggaugaacuacuacuggacccuccugaagccgggcgacaccaucaucuucgaggccaacggcaaccugaucgcccccauguacgcguucgcccucagccgcggguucggcuccgggaucaucacgagcaacgccuccaugcacgagugcaacaccaagugccagacgccccugggcgccaucaacucgucccugcccuaccagaacauccacccggugaccaucggcgagugccccaaguacgugcggagcgccaagcuccgcauggucaccgggcugcggaacauccccuccauccagucgcgcggccuguucggggcgaucgccggcuucaucgagggcggguggaccggcaugaucgacgggugguacggcuaccaccaccagaacgagcagggguccggcuacgccgccgaccagaaguccacccagaacgccaucaacgggaucaccaacaaggugaacacggugaucgagaagaugaacauccaguucaccgcggucggcaaggaguucaacaagcucgagaagcggauggagaaccugaacaagaagguggacgacggcuuccuggacaucuggaccuacaacgccgagcuccuggugcugcucgagaacgagcgcacccuggacuuccacgacagcaacaugaagaaccuguacgagaaggucaagucgcagcucaagaacaacgccaaggagaucgggaacggcugcuucgaguucuaccacaagugcgacaacgagugcauggaguccgugcggaacgggacguacgacuaccccaaguacagcgaggaguccaagcugaaccgcgagaaggucgacggcgugaagcuggagucgauggggaucuaccagauccucgccaucuacuccaccguggccagcucccugguccugcucgugucgcugggcgcgaucagcuucuggaugugcuccaacggcagccugcagugccggaucugcaucuga

SEQ ID NO: 10350 - RNA, 1698 nt, Artificial Sequence
  derived and/or modified CDS sequence (AUadapt) from InfluenzaA__AGO00385__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucgagaucuuccccaaggagagcuccuggcccgaccacaacaccaacggcgugaccgccgccugcucgcacgaggggaaguccagcuucuaccggaaccugcucuggcugaccgagaaggaguccucguaccccaagcugaagaacuccuacgucaacaagaagggcaaggaggugcucgugcugugggggauccaccacccgcccaacagcaaggagcagcagaaccuguaccagaacgagaacgcguacgucuccguggugacgucgaacuacaaccgccgguucacccccgagaucgccgagcgccccaagguccgggaccaggccggccgcaugaacuacuacuggacccuccugaagccgggcgacaccaucaucuucgaggccaacgggaaccugaucgcccccauguacgcguucgcccucagccggggcuucggguccggcaucaucacgagcaacgccuccaugcacgagugcaacaccaagugccagacgccccugggcgccaucaacucgucccugcccuaccagaacauccacccggugaccaucggggagugccccaaguacgugcgcagcgccaagcuccggauggucaccggccugcgcaacauccccuccauccagucgcgggggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcgcaacggcacguacgacuaccccaaguacagcgaggaguccaagcugaaccgggagaagguggacggggugaagcuggagucgaugggcaucuaccagauccucgccaucuacuccaccgucgccagcucccuggugcugcucgugucgcugggcgcgaucagcuucuggaugugcuccaacgggagccugcagugccgcaucugcaucuga

SEQ ID NO: 10351 - RNA, 1698 nt, Artificial Sequence
  derived and/or modified CDS sequence (AUadapt) from InfluenzaA__AGO00397__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucgagaucuuccccaaggagagcuccuggcccgaccacaacaccaacggcgugaccgccgccugcucgcacgaggggaaguccagcuucuaccggaaccugcucuggcugaccgagaaggaguccucguaccccaagcugaagaacuccuacgucaacaagaagggcaaggaggugcucgugcugugggggauccaccacccgcccaacagcaaggagcagcagaaccuguaccagaacgagaacgcguacgucuccguggugacgucgaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucagccgcggcuucggguccggcaucaucacgagcaacgccuccaugcacgagugcaacaccaagugccagacgccccugggcgccaucaacucgucccugcccuaccagaacauccacccggugaccaucggggagugccccaaguacgugcggagcgccaagcuccgcauggucaccggccugcggaacauccccuccauccagucgcgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagucgcagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagucgaugggcaucuaccagauccucgccaucuacuccaccgucgccagcucccuggugcugcucgugucgcugggcgcgaucagcuucuggaugugcuccaacgggagccugcagugccggaucugcaucuga

SEQ ID NO: 10352 - RNA, 1698 nt, Artificial Sequence
  derived and/or modified CDS sequence (AUadapt) from InfluenzaA__AGO00409__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucgagaucuuccccaaggagagcuccuggcccgaccacaacaccaacggcgugaccgccgccugcucgcacgaggggaagaacuccuucuaccggaaccugcucuggcugaccgagaagaaguccagcuaccccgagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10353 - RNA, 1698 nt, Artificial Sequence
  derived and/or modified CDS sequence (AUadapt) from InfluenzaA__AGO00421__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggucguacaucgucgagacgcccaacuccgagaacgggaucugcuacccgggcgacuucaucgacuacgaggagcuccgcgagcagcugagcuccgugucguccuucgagcgguucaagaucuuccccaaggagagcuccuggcccgaccacaacaccaccggggugaccgccgccugcucgcacgagggcaagaacuccuucuaccgcaaccugcucuggcugacgaagaaggagagcuccuaccccgagcugaagaacucguacgucaacaagaagcggaaggaggugcucgugcugugggggauccaccacccgcccaacuccaaggagcagcagaaccuguaccagaacgagaacgcguacgucagcguggugaccuccaacuacaaccgccgguucacccccgagaucgccgagcgccccaaggucaagggccaggccggccggaugaacuacuacuggacccuccugaagccgggggacacgaucaucuucgaggccaacggcaaccugaucgcccccauguacgcguucgcccucucgcgcggguucggcagcggcaucaucaccuccaacgccucgaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccucgauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucacgaacaaggugaacaccgugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacgcuggacuuccacgacucgaacgucaagaaccuguacgagaaggugaagucccagcucaagaacaacgccaaggagaucgggaacggcugcuucgaguucuaccacaagugcgacaacgagugcauggagagcguccggaacgggaccuacgacuaccccaaguacuccgaggagucgaagcugaaccgcgagaagguggacggcgugaagcuggaguccaugggcaucuaccagauccucgccaucuacagcaccgucgccuccucgcuggugcugcucgugucccugggggcgaucagcuucuggaugugcagcaacggcucccugcagugccggaucugcaucuga

SEQ ID NO: 10354 - RNA, 1698 nt, Artificial Sequence
  derived and/or modified CDS sequence (AUadapt) from InfluenzaA__AGO00433__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcuggagaacucguacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10355 - RNA, 1698 nt, Artificial Sequence
  derived and/or modified CDS sequence (AUadapt) from InfluenzaA__AGO00445__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccacgcugaagaacucguacgucaacaagaagggcaaggaggugcucgugcugugggggauccaccacccgcccaacuccaaggagcagcagaaccuguaccagaacgagaacgcguacgucagcguggugaccuccaacuacaaccggcgcuucacccccgagaucgccgagcggcccaagguccgcgaccaggccggccggaugaacuacuacuggacccuccugaagccgggcgacacgaucaucuucgaggccaacgggaaccugaucgcccccauguacgcguucgcccucucgcgcggcuucgggagcggcaucaucaccuccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucacgaacaaggugaacaccgugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacgcuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcaccuacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10356 - RNA, 1701 nt, Artificial Sequence
  derived and/or modified CDS sequence (AUadapt) from InfluenzaA__AGO02696__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaucuccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgcggccuccagccugguccugguggugucccucggcgccaucucguucuggaugugcagcaacggcucccugcagugccggaucugcaucuga

SEQ ID NO: 10357 - RNA, 1701 nt, Artificial Sequence; identical to SEQ ID NO: 10285
  derived and/or modified CDS sequence (AUadapt) from InfluenzaA__AGO02697__HA

SEQ ID NO: 10358 - RNA, 1701 nt, Artificial Sequence; identical to SEQ ID NO: 10103
  derived and/or modified CDS sequence (AUadapt) from InfluenzaA__AGO02698__HA

SEQ ID NO: 10359 - RNA, 1701 nt, Artificial Sequence; identical to SEQ ID NO: 10103
  derived and/or modified CDS sequence (AUadapt) from InfluenzaA__AGO02699__HA

SEQ ID NO: 10360 - RNA, 1701 nt, Artificial Sequence
  derived and/or modified CDS sequence (AUadapt) from InfluenzaA__AGO02700__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuacccccgcuacuccgaggaggcgaagcucaaccgggaggagaucgacggcaucaagcuggagagcacccgcaucuaccagauccuggccaucuacuccaccguggccucgagccucguccugaucgugucccugggggccaucucguucuggaugugcuccaacggcagccuccagugccggaucugcaucuga

SEQ ID NO: 10361 - RNA, 1701 nt, Artificial Sequence
  derived and/or modified CDS sequence (AUadapt) from InfluenzaA__AGO02701__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucaacuacgaggagcuccgggagcagcugucguccgugagccacuucgagcgcuucgagaucuuccccaagaccuccucguggcccaaccacgacuccaacaagggggucaccgccgccugcccgcacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcagucccuguaccagaacgccgacgccuacguguucgugggcacgucgaaguacuccaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcuccgccuggcgaccggccugcggaacgucccgagcauccagucccgcggccucuucggggccaucgccggguucaucgagggcggcuggacggggaugguggacggcugguacggguaccaccaccagaacggccaggggucgggcuacgccgccgaccugaaguccacccagaacgcgaucgacaagaucaccaacaaggugaacagcgucaucgagaagaugaacacccaguucacggccgugggcaaggaguucaaccaccuggagaagcggaucgagaaccucaacaagaaggucgacgacggguuccuggacaucuggaccuacaacgccgagcugcucgugcugcuggagaacgagcgcacccucgacuaccacgacuccaacgugaagaaccuguacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggcgaucuacucgaccgucgccuccagccucgugcugguggucucgcugggcgccaucuccuucuggaugugcagcaacggcucccuccagugccgcaucugcaucuga

SEQ ID NO: 10362 - RNA, 1683 nt, Artificial Sequence; identical to SEQ ID NO: 86
  derived and/or modified CDS sequence (AUadapt) from InfluenzaA__AGO51374__HA

SEQ ID NO: 10363 - RNA, 1701 nt, Artificial Sequence
  derived and/or modified CDS sequence (AUadapt) from InfluenzaA__AGO86686__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggucgaaggcguacuccaacugcuaccccuacgacgugccggacuacgccagccuccgcucccugguggccucguccggcacgcuggaguucaacaacgagagcuucaacuggaccggggucgcccagaacggcaccuccucggcgugcaagcggcgcuccaucaagucguucuucucccggcucaacuggcugcaccagcuggagaaccgcuaccccgcccucaacgugaccaugcccaacaacgacaaguucgacaagcuguacaucuggggcgugcaccaccccagcacggacuccgaccagaucucggucuacgcccaggccagcgggcgggugaccguguccaccaagcgcucgcagcagaccgucaucccgaacaucgggucccggcccugggugcgcggcaucucgucccggaucagcaucuacuggacgaucgugaagcccggcgacauccugcucaucaacuccaccgggaaccugaucgcgccccgcggcuacuucaagauccggucggggaaguccagcaucaugcgcuccgacgccccgaucggcaagugcaacucggagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagcggacccgcaagcagcugcgcgagaacgccgaggacaugggcaacgggugcuucaagaccuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 10364 - RNA, 1701 nt, Artificial Sequence; identical to SEQ ID NO: 10285
  derived and/or modified CDS sequence (AUadapt) from InfluenzaA__AGQ16240__HA

SEQ ID NO: 10365 - RNA, 1701 nt, Artificial Sequence; identical to SEQ ID NO: 10285
  derived and/or modified CDS sequence (AUadapt) from InfluenzaA__AGQ16241__HA

SEQ ID NO: 10366 - RNA, 1701 nt, Artificial Sequence
  derived and/or modified CDS sequence (AUadapt) from InfluenzaA__AGQ16242__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaccucguacaucaacgacaagggcaaggagauccuggugcucugggggauccaccaccccagcacgaccgccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucacguucgaggcgaccggcaaccucguggugccccgguacgccuucgccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgcgaccggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucacgaacaaggugaacucggugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 10367 - RNA, 1701 nt, Artificial Sequence; identical to SEQ ID NO: 10305
  derived and/or modified CDS sequence (AUadapt) from InfluenzaA__AGQ16243__HA

SEQ ID NO: 10368 - RNA, 1701 nt, Artificial Sequence
  derived and/or modified CDS sequence (AUadapt) from InfluenzaA__AGQ16245__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 10369 - RNA, 1701 nt, Artificial Sequence; identical to SEQ ID NO: 10305
  derived and/or modified CDS sequence (AUadapt) from InfluenzaA__AGQ16247__HA

SEQ ID NO: 10370 - RNA, 1701 nt, Artificial Sequence
  derived and/or modified CDS sequence (AUadapt) from InfluenzaA__AGQ16248__HA
augcaggccauccuggugguccuccuguacaccuucgccaccgcgacggccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcacgaccgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggucgggcaucaucaucuccgacacccccauccacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacgcagaacgccaucgacaagaucaccaacaaggugaacucggugaucgagaagaugaacacccaguucaccgcggucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 10371 - RNA, 1701 nt, Artificial Sequence; identical to SEQ ID NO: 10103
  derived and/or modified CDS sequence (AUadapt) from InfluenzaA__AGQ16329__HA

SEQ ID NO: 10372 - RNA, 1701 nt, Artificial Sequence; identical to SEQ ID NO: 10128
  derived and/or modified CDS sequence (AUadapt) from InfluenzaA__AGQ16331__HA

SEQ ID NO: 10373 - RNA, 1701 nt, Artificial Sequence; identical to SEQ ID NO: 10103
  derived and/or modified CDS sequence (AUadapt) from InfluenzaA__AGQ16332__HA

SEQ ID NO: 10374 - RNA, 1701 nt, Artificial Sequence; identical to SEQ ID NO: 10103
  derived and/or modified CDS sequence (AUadapt) from InfluenzaA__AGQ16333__HA

SEQ ID NO: 10375 - RNA, 1701 nt, Artificial Sequence
  derived and/or modified CDS sequence (AUadapt) from InfluenzaA__AGQ16335__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccaggugcucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcagagcuccgggcgcaucaccgugucgaccaagcggagccagcaggccgucaucccgaacaucggcucccgcccccggauccgcaacauccccucgcggaucuccaucuacuggacgaucgugaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgucaagcagaacacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 10376 - RNA, 1701 nt, Artificial Sequence
  derived and/or modified CDS sequence (AUadapt) from InfluenzaA__AGQ16336__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaaccgguccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcucgcagcaggccgugaucccgaacaucggcagccggccccgcauccggaacauccccucccgcaucucgaucuacuggacgaucgucaagcccggcgacauccugcucaucaacuccaccgggaaccugaucgccccgcggggcuacuucaagauccgcagcgggaaguccucgaucaugcgguccgacgcccccaucggcaagugcaagagcgagugcaucacccccaacggcuccauccccaacgacaagccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 10377 - RNA, 1701 nt, Artificial Sequence; identical to SEQ ID NO: 10375
  derived and/or modified CDS sequence (AUadapt) from InfluenzaA__AGQ16337__HA

SEQ ID NO: 10378 - RNA, 1701 nt, Artificial Sequence; identical to SEQ ID NO: 10113
  derived and/or modified CDS sequence (AUadapt) from InfluenzaA__AGQ16338__HA

SEQ ID NO: 10379 - RNA, 1701 nt, Artificial Sequence
  derived and/or modified CDS sequence (AUadapt) from InfluenzaA__AGQ16339__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaagaacuggauccuguggaucuccuucgccaucagcugcuuccugcugugcgucgcccugcucggguucaucaugugggcgugccagaagggcaacauccggugcaacaucugcaucuga

SEQ ID NO: 10380 - RNA, 1701 nt, Artificial Sequence; identical to SEQ ID NO: 162
  derived and/or modified CDS sequence (AUadapt) from InfluenzaA__AGQ16340__HA

SEQ ID NO: 10381 - RNA, 1701 nt, Artificial Sequence; identical to SEQ ID NO: 10103
  derived and/or modified CDS sequence (AUadapt) from InfluenzaA__AGQ16341__HA

SEQ ID NO: 10382 - RNA, 1701 nt, Artificial Sequence; identical to SEQ ID NO: 10113
  derived and/or modified CDS sequence (AUadapt) from InfluenzaA__AGQ16342__HA

SEQ ID NO: 10383 - RNA, 1701 nt, Artificial Sequence
  derived and/or modified CDS sequence (AUadapt) from InfluenzaA__AGQ16343__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccgggacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10384 - RNA, 1701 nt, Artificial Sequence; identical to SEQ ID NO: 10113
  derived and/or modified CDS sequence (AUadapt) from InfluenzaA__AGQ16344__HA

SEQ ID NO: 10385 - RNA, 1701 nt, Artificial Sequence; identical to SEQ ID NO: 10103
  derived and/or modified CDS sequence (AUadapt) from InfluenzaA__AGQ16345__HA

SEQ ID NO: 10386 - RNA, 1701 nt, Artificial Sequence
  derived and/or modified CDS sequence (AUadapt) from InfluenzaA__AGQ16346__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugccgguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 10387 - RNA, 1701 nt, Artificial Sequence; identical to SEQ ID NO: 10103
  derived and/or modified CDS sequence (AUadapt) from InfluenzaA__AGQ16347__HA

SEQ ID NO: 10388 - RNA, 1701 nt, Artificial Sequence; identical to SEQ ID NO: 162
  derived and/or modified CDS sequence (AUadapt) from InfluenzaA__AGQ16348__HA

SEQ ID NO: 10389 - RNA, 1701 nt, Artificial Sequence; identical to SEQ ID NO: 10103
  derived and/or modified CDS sequence (AUadapt) from InfluenzaA__AGQ16349__HA

SEQ ID NO: 10390 - RNA, 1701 nt, Artificial Sequence
  derived and/or modified CDS sequence (AUadapt) from InfluenzaA__AGQ16350__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucauguggaccugccagaaggggaacauccgcugcaacaucugcaucuga

SEQ ID NO: 10391 - RNA, 1701 nt, Artificial Sequence
  derived and/or modified CDS sequence (AUadapt) from InfluenzaA__AGQ47719__HA
augaaggccauccugcucgugcugcugugcaccuucaccgccacgaacgcggacacccucugcaucggcuaccacgccaacaacucgaccgacaccgucgacacggugcuggagaagaacgugaccgucacccacuccgugaaccugcucgaggaccgccacaacgggaagcugugcaagcugggcgggaucgcgccccuccaccugggcaagugcaacaucgccggguggcugcucggcaacccggagugcgagcugcuguucaccgugagcuccuggucguacaucgucgagacguccaacagcgacaacgggaccugcuaccccggcgacuucaucaacuacgaggagcuccgggagcagcuguccucgguguccagcuucgagcgcuucgagaucuuccccaagaccuccucguggcccgaccacgagaccaaccggggcgugacggccgccugcccguacgccggggccaacuccuucuaccgcaaccugaucuggcucgucaagaagggcaacagcuaccccaagcuguccaagucguacgugaacaacaaggggaaggaggugcugguccucuggggcauccaccacccgcccaccuccaccgaccagcagagccuguaccagaacgccgacgcguacguguucgugggcuccucgaaguacaaccggaaguucaagcccgagaucgccgcccgccccaagguccgggggcaggccggccgcaugaacuacuacuggacccugaucgagcccggggacacgaucaccuucgaggccaccggcaaccucguggugccccgguacgcguucgccaugaaccgcggcagcggguccggcaucaucaucucggacgccccgauccacgacugcaacaccaagugccagacgcccaagggggccaucaacaccucccugcccuuccagaacauccaccccgucaccaucggcgagugcccgaaguacgucaagagcaccaagcugcggauggccacggggcuccgcaacauccccuccauccagucgcggggccuguucggcgcgaucgccggguucaucgagggcggguggaccggcaugaucgacgggugguacggcuaccaccaccagaacggccagggguccggcuacgccgccgaccagaaguccacccagaacgccaucgacgggaucaccaacaaggugaacagcgugaucgagaagaugaacacgcaguucaccgcggugggcaaggaguucaaccaccuggagaagcgcaucgagaaccucaacaagaagguggacgacggguuccuggacgucuggaccuacaacgccgagcugcucgugcugcuggagaacgagcggacccucgacuuccacgacucgaacgucaagaaccuguacgagaaggugcgcucccagcugcggaacaacgccaaggagaucggcaacggcugcuucgaguucuaccacaagugcgacgacacgugcauggagagcgugaagaacgggaccuacgacuaccccaaguacuccgaggagucgaagcucaaccgcgaggagaucgacggcgucaagcuggaguccacccggaucuaccagauccuggccaucuacagcaccgccgcguccucgcucgugcugcuggugucccucggggccaucagcuucuggaugugcagcaacggcucccugcagugccgcaucugcaucuga

SEQ ID NO: 10392 - RNA, 1698 nt, Artificial Sequence; identical to SEQ ID NO: 2360
  derived and/or modified CDS sequence (AUadapt) from InfluenzaA__AGQ47728__HA

SEQ ID NO: 10393 - RNA, 1701 nt, Artificial Sequence
  derived and/or modified CDS sequence (AUadapt) from InfluenzaA__AGQ47740__HA
augaaggcccgccugcucgugcugcugugcgcccucgcggccaccgacgccgacaccaucugcaucggcuaccacgccaacaacucgacggacaccgucgacacccugcuggagaagaacgugaccgugacgcacuccgucaaccuccuggaggacagccacaacgggaagcugugcaagcucaagggcaucgcgccccugcagcuggggaagugcaacaucgccggcuggcuccuggggaacccggagugcgacucccugcuccccgcccggucgugguccuacaucguggagacccccaacagcgagaacggcgccugcuaccccggcgacuucaucgacuacgaggagcugcgcgagcagcuguccagcguguccucgcucgagcgguucgagaucuucccgaaggaguccagcuggcccaaccacaacaccaucaagggggucaccgccuccugcucgcaccgcggccaguccagcuucuaccggaaccugcuguggcucacgaagaagggggacuccuaccccaagcugaacaacagcuacgugaacaacaagggcaaggaggugcugguccucuggggcgugcaccaccccuccucgagcaacgagcagcagucccuguaccgcaacgagaacgcguacgugagcgucguguccucgaacuacaaccggcgcuucaccccggagaucgccgcccggcccaaggugcgcgaccagaccgggcggaugaacuacuacuggacccugcucgagcccggcgacacgaucauguucgaggccaccgggaaccugaucgcccccugguacgcguucgcccugucccgcggcuucgggagcggcaucaucaccuccaacgccucgaugcacgagugcaacaccaagugccagacgccgcagggcgccaucaacuccagccuccccuuccagaacauccaccccgucaccaucggggagugccccaaguacgugcgguccaccaagcugcgcauggugaccggccugcggaacaucccgagcauccagucccgcggccucuucggggccaucgcgggguucaucgagggcggcuggacggggaugaucgacggcugguacggguaccaccaccagaacgagcagggcucgggguacgccgccgaccagaaguccacccagaacgccaucaacggcaucaccaacaaggucaacagcgugaucgagaagaugaacacccaguucacggccgugggcaaggaguucaacaaccuggagaagcggauggagaaccugaacaagaaggucgacgacggguuccucgacaucuggaccuacaacgcggagcugcuggugcuccuggagaacgagcgcacccuggacuuccacgaccucaacgugaagaaccuguacgagaaggucaagucccagcugaagaacaacgccaaggagaucggcaacgggugcuucgaguucuaccacaagugcgacaacgagugcauggagucggugcggaacggcaccuacgacuaccccaaguacuccgaggagagcaagcucaaccgcgagaagaucgacggggucaagcuggagagcaugggcguguaccagauccuggccaucuacuccacgguggccucgucccucguccugcuggugagccugggcgccaucuccuucuggaugugcagcaacgggucccuccagugccggaucugcaucuga

SEQ ID NO: 10394 - RNA, 1701 nt, Artificial Sequence
  derived and/or modified CDS sequence (AUadapt) from InfluenzaA__AGQ47752__HA
augaaggccaagcugcucauccugcugugcgcccucucggcgaccgacgccgacaccaucugcaucggcuaccacgccaacaacuccacggacaccguggacaccguccuggagaagaacgugaccgugacgcacucggucaaccugcucgaggacucccacaacgggaagcugugccgccugaagggcaaggcgccccuccagcuggggaagugcaacaucgccggcugggugcuggggaacccggagugcgagagccuccuguccaaccggucgugguccuacaucgccgagacccccaacagcgagaacggcaucugcuaccccggcgacuucgccgacuacgaggagcugcgcgagcagcucuccucgguguccucguucgagcgguucgagaucuuccccaaggagcgcuccuggccgaagcacaacaccauccgcggggucaccgccgccugcagccacgcgggcaaguccucguucuacaagaaccugguguggcugacggaggccaacggguccuaccccgcccucagcaccuccuacgugaacaaccaggagaaggagguccuggugcuguggggcgugcaccaccccucgaacaucgaggagcagcggacccucuaccggaaggacaacgccuacgucucggugguguccagcaacuacaaccgccgguucacccccgagaucgccaagcgcccgaagguccgggaccagcccgggcgcaugaacuacuacuggacgcugcuggagcccggcgacaccaucaucuucgaggcgaccggcaaccucaucgcccccugguacgccuucgcccugucccgggggccgggcucggggaucaucaccuccaacgcccccauggacgagugcgacacgaagugccagacgccccagggcgcgaucaacagcucccugcccuuccagaacauccacccggugaccaucggcgagugccccaaguacgugcgcucgaccaagcuccggauggucaccgggcugcgcaacauccccuccauccagucgcggggccuguucggggccaucgccggcuucaucgagggcggguggaccggcaugauggacgggugguacggcuaccaccaccagaacgagcagggguccggcuacgccgccgaccagaaguccacccagaacgcgaucaacgggaucaccaacaaggugaacagcgugaucgagaagaugaacacgcaguucaccgccgucggcaaggaguucaacaagcucgagaagcgcauggagaaccugaacaagaagguggacgacggcuuccuggacaucuggaccuacaacgccgagcuccuggugcugcucgagaacgagcggacccuggacuuccacgacucgaacgucaagaaccuguacgagaaggugaagaaccagcuccgcaacaacgccaaggagcuggggaacggcugcuucgaguucuaccacaagugcgacaacgagugcauggaguccgucaagaacgggacguacgacuaccccaaguacagcgaggaguccaagcugaaccgggagaagaucgacggcgugaagcucgagucgauggggguguaccgcauccuggccaucuacuccaccgucgcgucgagccuggugcuccuggugucccugggcgccaucucguucuggaugugcuccaacggcagccuccagugccgcaucugcaucuga

SEQ ID NO: 10395 - RNA, 1701 nt, Artificial Sequence
  derived and/or modified CDS sequence (AUadapt) from InfluenzaA__AGQ47764__HA
augaaggccaagcugcucauccugcugugcgcccucaccgcgaccgacgccgacacgaucugcaucggcuaccacgccaacaacucgaccgacaccguggacaccguccuggagaagaacgugacggugacccacuccgucaaccugcucgaggacucgcacaacgggaagcugugccgccugaagggcaucgcgccccuccagcuggggaagugcaacaucgccggcuggauccuggggaacccggagugcgagucccuccugagcaagcgguccuggucguacaucgccgagacccccaacuccgagaacggcgccugcuaccccggcgacuucgccgacuacgaggagcugcgcgagcagcucagcuccgugucguccuucgagcgguucgagaucuuccccaaggagcgcagcuggccgaagcacaacaucacccgcggggugacggccgcgugcucccacgccggcaagucguccuucuacaagaaccugcuguggcucaccgagaccgacgggagcuaccccaagcuguccaagucguacgucaacaacaaggagaaggaggugcuggugcucuggggcguccaccaccccuccaacaucgaggaccagaagacccuguaccggaaggagaacgccuacgugagcguggucucguccaacuacaaccggcgcuucacgcccgagaucgccgagcggccgaaggugcgcgggcaggccggccggaucaacuacuacuggacccugcucgagcccggcgacaccaucaucuucgaggcgaacgggaaccugaucgcccccugguacgccuucgcccugagccgcgacuucggcuccgggaucaucaccucgaacgccuccauggacgagugcgacacgaagugccagacgccccagggcgcgaucaacagcucccucccguuccagaacauccaccccgugaccaucggcgagugccccaaguacgucaagucgaccaagcugcggauggugaccgggcugcgcaacauccccuccauccagagccggggccucuucggggccaucgccggcuucaucgagggcggguggaccggcaugaucgacgggugguacggcuaccaccaccagaacgagcagggguccggcuacgccgccgaccagaaguccacccagaacgcgaucaacgggaucaccaacaaggugaacucggucaucgagaagaugaacacgcaguucaccgccgugggcaaggaguucaacaagcuggagaagcgcauggagaaccugaacaagaagguggacgacggcuuccucgacaucuggaccuacaacgccgagcugcugguccuccuggagaacgagcggacccuggacuuccacgacagcaacgugaagaaccucuacgagaaggugaagaaccagcugcgcaacaacgccaaggagaucgggaacggcugcuucgaguucuaccacaagugcaacaacgagugcauggaguccgucaagaacgggacguacgacuacccgaaguacucggaggaguccaagcugaaccgggagaagaucgacggcgugaagcucgagagcaugggggucuaccagauccuggccaucuacuccaccguggcgucgagccuggugcuccuggucucccugggcgccaucucguucuggaugugcuccaacggcagccuccagugccgcaucugcaucuga

SEQ ID NO: 10396 - RNA, 1701 nt, Artificial Sequence
  derived and/or modified CDS sequence (AUadapt) from InfluenzaA__AGQ47776__HA
augaaggccaagcugcucauccugcugugcgcccucucggcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagucgcuccuguccaagcggagcugguccuacaucgccgagacccccaacucggagaacgggaccugcuaccccggcgacuucgccgacuacgaggagcugcgcgagcagcucuccagcguguccucguucgagcgguucgagaucuuccccaaggagcgcuccuggccgaagcacaacaucaacaucggcgugaccgccgccugcagccacgcgggcaaguccucguucuacaagaaccugcuguggcucacggagaaggacggguccuaccccaaccugaacaagagcuacgucaacaagaaggagaaggaggugcuggugcucuggggcguccaccaccccuccaacaucgaggaccagaagacccuguaccggaaggagaacgccuacgugucgguggucagcuccaacuacaaccgccgguucacccccgagaucgccgagcgcccgaaggugcgggggcaggccggccgcaugaacuacuacuggacccugcucgagcccggcgacacgaucaucuucgaggccaacgggaaccugaucgcgcccugguacgccuucgcccugucgcggggccucggguccggcaucaucaccagcaacgccuccauggacgagugcgacaccaagugccagacgccccagggcgccaucaacucgucccugccguuccagaacauccaccccuucaccaucggggagugccccaaguacgugcgcagcaccaagcugcggauggucaccggccuccgcaacauccccuccauccagucgcgggggcuguucggcgcgaucgccggguucaucgagggcggcuggaccgggaugaucgacggcugguacggguaccaccaccagaacgagcagggcuccggguacgccgccgaccagaaguccacgcagaacgccaucaacggcaucaccaacaaggugaacagcgugaucgagaagaugaacacccaguucaccgcggucggcaaggaguucaacaagcuggagaagcgcauggagaaccucaacaagaagguggacgacggguuccuggacaucuggacguacaacgccgagcugcucgugcugcuggagaacgagcggacccucgacuuccacgacucgaacgucaagaaccuguacgagaaggugaagaaccagcugcgcaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggggucaagcuggagucgaugggcguguaccagauccuggccaucuacuccaccgucgccagcucgcucgugcugcuggugucccucggcgcgaucagcuucuggaugugcuccaacgggagccugcagugccgcaucugcaucuga

SEQ ID NO: 10397 - RNA, 1701 nt, Artificial Sequence
  derived and/or modified CDS sequence (AUadapt) from InfluenzaA__AGQ47788__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagucgcucuucuccaagaaguccuggagcuacaucgccgagacccccaacucggagaacgggaccugcuaccccggcuacuucgccgacuacgaggagcugcgggagcagcuguccagcguguccagcuucgagcgcuucgagaucuuccccaaggagcgguccuggccgaagcacaacgucacccgcggcgugacggccgccugcucgcacaagggcaaguccagcuucuaccggaaccuccuguggcugaccgagaaggacggguccuaccccaaccucucgaaguccuacgugaacaacaaggagaaggagguccuggugcuguggggcgugcaccaccccagcaacaucgaggaccagaagacccucuaccgcaaggagaacgcguacgucucggugguguccagcaacuacaaccggcgcuucacccccgagaucgccgagcggccgaagguccgcgggcaggccggccggaucaacuacuacuggacgcugcuggagcccggcgacaccaucaucuucgaggccaacgggaaccucaucgcccccuggcacgcguucgcccugucccgcggcuucgggagcggcaucaucaccuccaacgccucgauggacgagugcgacaccaagugccagacgccccagggcgccaucaacuccagccugccguuccagaacauccaccccgugaccaucggggagugccccaaguacgugcgguccaccaagcuccgcauggucaccggccugcggaacauccccucgauccagucccgcgggcuguucggcgccaucgcgggguucaucgagggcggcuggacggggaugaucgacggcugguacggguaccaccaccagaacgagcagggcagcggguacgccgccgaccagaaguccacccagaacgccaucaacggcaucaccaacaaggugaacucggugaucgagaagaugaacacccaguucacggccgucggcaaggaguucaacaagcucgagaagcggauggagaaccugaacaagaagguggacgacggguuccuggacaucuggaccuacaacgcggagcuccuggugcugcucgagaacgagcgcacccuggacuuccacgacuccaacgucaagaaccuguacgagaaggucaagagccagcucaagaacaacgccaaggagaucggcaacgggugcuucgaguucuaccacaagugcaacaacgagugcauggaguccgugaagaacggcaccuacgacuacccgaaguacagcgaggaguccaagcugaaccgggagaagaucgacggggugaagcuggagucgaugggcguguaccagauccucgccaucuacagcacggucgccuccucgcuggugcugcucgugucccugggcgccaucagcuucuggaugugcuccaacgggagccugcagugccgcaucugcaucuga

SEQ ID NO: 10398 - RNA, 1701 nt, Artificial Sequence
  derived and/or modified CDS sequence (AUadapt) from InfluenzaA__AGQ47800__HA
augaaggcccgccugcucgugcugcugugcgcccucgcggccaccgacgccgacaccaucugcaucggcuaccacgccaacaacucgacggacaccgucgacaccauccuggagaagaacgugaccgugacgcacuccgucaaccugcucgaggacagccacaacgggaagcugugccggcugaagggcaucgcgccccuccagcuggggaagugcaacaucgccggcuggauccuggggaacccggagugcgagucccuccugucggagcgcuccuggagcuacaucguggagauccccaacuccgagaacgggaccugcuaccccggcgacuucaccgacuacgaggagcugcgggagcagcucucguccgugagcuccuucgagcgcuucgagaucuuccccaaggagagcuccuggccgaagcacaacaccgcccgcggggucacggccgccugcucgcacgcgggcaaguccagcuucuaccggaaccugcuguggcucaccgagaaggacggguccuaccccaaccugaagaacucguacgugaacaagaagggcaaggaggugcugguccucuggggcgugcaccaccccuccagcaucaaggagcagcagacccuguaccagaaggagaacgccuacgugucggucguguccagcaacuacaaccggcgcuucacccccgagaucgccgagcggccgaaggugcgcgaccaggccggccggaugaacuacuacuggacgcugcucgagcccggcgacaccaucaucuucgaggccaacgggaaccugaucgcgcccugguacgccuucgcccugucccgcggcuucgggagcggcaucaucaccuccaacgccucgaugcacgagugcgacaccaagugccagacgccccagggcgccaucaacuccagccucccguuccagaacauccaccccgucaccaucggggagugccccaaguacgugcgguccaccaagcugcgcauggugaccggccugcggaacauccccucgauccagucccgcggccucuucggggcgaucgccggguucaucgagggcggcuggacggggaugaucgacggcugguacggguaccaccaccagaacgagcagggcagcggguacgccgccgaccagaaguccacccagaacgccaucaacggcaucaccaacaaggucaacucggugaucgagaagaugaacacccaguucacggcggugggcaaggaguucaacaaccuggagaagcggauggagaaccugaacaagaaggucgacgacggguuccucgacaucuggaccuacaacgccgagcugcugauccuccuggagaacgagcgcacccuggacuuccacgacuccaacgugaagaaccucuacgagaaggucaagagccagcugcggaacaacgccaaggagaucggcaacgggugcuucgaguucuaccacaagugcaacaacgagugcauggaguccgugaagaacggcaccuacgacuacccgaaguacagcgaggaguccaagcugaaccgcgagaagaucgacggggugaagcucgagucgaugggcgucuaccagauccuggccaucuacagcacgguggccuccucgcuggugcuccuggucucccugggcgcgaucagcuucuggaugugcuccaacgggagccuccagugccggaucugcaucuga

SEQ ID NO: 10399 - RNA, 1701 nt, Artificial Sequence
  derived and/or modified CDS sequence (AUadapt) from InfluenzaA__AGQ47811__HA
augaaggccaagcugcucgugcugcugugcgcccucucggcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagucgcucuucuccaagaaguccuggagcuacaucgccgagacccccaacagcgagaacgggaccugcuaccccggcuucuucgccgacuacgaggagcugcgggagcagcuguccucgguguccagcuucgagcgcuucgagaucuuccccaaggagcgguccuggccgaagcacaacgucacccgcggcgugacggccgccugcucgcacaagggcaaguccagcuucuaccggaaccuccuguggcugaccgagaagaacggguccuaccccaaccucagcaaguccuacgugaacaacaaggagaaggagguccuggugcuguggggcgugcaccaccccucgaacaucgaggaccagaagaccaucuaccgcaaggagaacgcguacgucagcgugguguccagcaacuacaaccggcgcuucacccccgagaucgccgagcggccgaagguccgcgggcaggccggccggaucaacuacuacuggacgcuccuggagcccggcgacaccaucaucuucgaggccaacgggaaccugaucgcccccuggcacgcguucgcccucucccgcggcuucgggucgggcaucaucaccuccaacgccagcauggacgagugcgacaccaagugccagacgccccagggcgccaucaacuccucgcugccguuccagaacauccaccccgugaccaucggggagugccccaaguacgugcgguccaccaagcugcgcauggucaccggccuccggaacauccccagcauccagucccgcgggcuguucggcgccaucgcgggguucaucgagggcggcuggacggggaugaucgacggcugguacggguaccaccaccagaacgagcagggcagcggguacgccgccgaccagaaguccacccagaacgccaucgacggcaucaccaacaaggugaacucggugaucgagaagaugaacacccaguucacggccgucggcaaggaguucaacaagcuggagaagcggauggagaaccucaacaagaagguggacgacggguuccuggacaucuggaccuacaacgcggagcugcucgugcugcuggagaacgagcgcacccucgacuuccacgacuccaacgucaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacucggaggaguccaagcucaaccgggagaagaucgacggggugaagcuggagagcaugggcguguaccagauccuggccaucuacagcacggucgccuccucgcucgugcugcuggugucccucggcgccaucagcuucuggaugugcuccaacgggagccugcagugccgcaucugcaucuga

SEQ ID NO: 10400 - RNA, 1701 nt, Artificial Sequence
  derived and/or modified CDS sequence (AUadapt) from InfluenzaA__AGQ47823__HA
augaaggccaagcugcucgugcugcugugcgccuucaccgcgaccuacgccgacacgaucugcaucggcuaccacgccaacaacucgaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccgaagugcgagagccuguucuccaaggagagcugguccuacaucgccgagacccccaaccccgagaacgggaccugcuaccccggcuacuucgccgacuacgaggagcuccgggagcagcugucguccgucagcuccuucgagcgcuucgagaucuucccgaaggagagcuccuggcccaaccacacggugaccaagggcgugaccaccagcugcucccacaacggcaagucguccuucuaccggaaccugcucuggcugacggagaagaacgggcuguaccccaaccucagcaaguccuacgucaacaacaaggagaaggaggugcuggugcuguggggcguccaccaccccagcaacauccgcgaccagcgggccaucuaccacaccgagaacgccuacgugagcguggucuccagccacuacucccgccgguucaccccggagaucgcgaagcgccccaaggugcgggggcaggagggccgcaucaacuacuacuggacccuccuggagcccggcgacacgaucaucuucgaggccaacgggaaccugaucgcccccugguacgccuucgcccucucgcggggcuucggguccggcaucaucaccagcaacgcguccauggacgagugcgacgccaagugccagaccccgcagggcgccaucaacagcucccugcccuuccagaacgugcaccccgucaccaucggggagugccccaaguacgugcgcagcacgaagcugcggauggugaccggccuccgcaacaucccguccauccagucgcgggggcuguucggcgccaucgccggguucaucgagggcggcuggaccgggaugaucgacggcugguacggguaccaccaccagaacgagcagggcuccggguacgcggccgaccagaaguccacccagaacgccaucaacggcaucacgaacaaggucaacagcgugaucgagaagaugaacacccaguucaccgccgugggcaaggaguucaacaagcuggagcgccggauggagaaccucaacaagaaggucgacgacggguuccuggacaucuggaccuacaacgccgagcugcucgugcugcuggagaacggccgcacgcucgacuuccacgacagcaacgucaagaaccuguacgagaaggugaagucccagcugaagaacaacgcgaaggagaucgggaacggcugcuucgaguucuaccacaagugcaacaacgagugcauggagagcgugaagaacgggaccuacgacuaccccaaguacuccgaggagucgaagcucaaccggggcaagaucgacggcgucaagcuggagagcauggggguguaccagauccuggccaucuacuccaccguggccagcucccucguccugcuggugagccucggcgccaucuccuucuggaugugcagcaacgggucccugcagugccgcaucugcaucuga

SEQ ID NO: 10401 - RNA, 1701 nt, Artificial Sequence
  derived and/or modified CDS sequence (AUadapt) from InfluenzaA__AGQ47835__HA
augaagaccaucaucgcccugucguacaucuucugccucgugcugggccaggacuuccccgggaacgacaacuccaccgccacgcugugccucggccaccacgcggucccgaacgggaccaucgugaagaccaucaccaacgaccagaucgaggugacgaacgccaccgagcugguccagagcuccucgaccggcaagaucugcaacaacccccaccgcauccuggacgggaucaacugcacccucaucgacgcccugcugggcgacccccacugcgacggcuuccagaacgagacgugggaccucuucguggagcgguccaaggccuucagcaacugcuaccccuacuacgugccggacuacgccucccugcgcucgcuggucgcguccagcgggacccucgaguucaucaacgagggcuucaacuggaccggggugacccagaacggcggguccaacgccugcaagcggggccccaacucgggcuucuucucccgccugaacuggcuguacaagagcgggacgaccuaccccgugcucaacgucaccaugcccaacaacgacaacuucgacaagcuguacaucuggggcgugcaccacccguccaccgaccaggagcagacgaaccuguacgugcaggccucggggcgggucaccguguccaccaagcgcagccagcagaccaucacgcccaacaucggcucccggcccugggugcgcggccucucgagccggaucuccaucuacuggaccaucgucaagcccggggacauccuggugaucaacucgaacggcaaccugaucgccccgcgcggguacuucaagaugcggaccggcaaguccagcaucaugcgcuccgacgcgcccaucgggaccugcaucucggagugcaucacgcccaacggcuccauccccaacgacaagccguuccagaacgugaacaagaucaccuacggcgccugccccaaguacgucaagcagaacacccucaagcuggccaccgggaugcggaacgugcccgagaagcagacgcgcggcaucuucggggccaucgccggcuucaucgagaacgggugggagggcaugguggacggcugguacggguuccggcaccagaacagcgagggcaccgggcaggcggccgaccugaaguccacccaggccgccaucgaccagaucaacggcaagcucaaccgcgucaucgagaagaccaacgagaaguuccaccagaucgagaaggaguucucggagguggaggggcggauccaggaccuggagaaguacguggaggacacgaagaucgaccugugguccuacaacgccgagcuccuggucgcgcuggagaaccagcacaccaucgaccucaccgacagcgagaugaacaagcuguucgagaagacccgccggcagcugcgcgagaacgccgaggacaugggcaacggcugcuucaagaucuaccacaagugcgacaacgccugcaucggguccauccggaacggcacguacgaccacgacguguaccgcgacgaggcccucaacaaccgcuuccagaucaagggggucgagcucaagucgggcuacaaggacuggauccuguggaucuccuucgccaucagcugcuuccugcugugcguggugcugcucggcuucaucaugugggcgugccagaaggggaacauccggugcaacaucugcaucuga

SEQ ID NO: 10402 - RNA, 1701 nt, Artificial Sequence
  derived and/or modified CDS sequence (AUadapt) from InfluenzaA__AGQ47847__HA
augaaggcccgccugcucauccugcugugcgcccucgcggccaccgacgccgacaccaucugcaucggcuaccacgccaacaacucgacggacaccguggacaccguccuggagaagaacgugaccgugacgcacuccgucaaccugcucgaggacagccacaacgggaagcugugccggcugaagggcaucgcgccccuccagcuggggaagugcaacaucgccggcuggcugcucgggaacccggagugcgacucccugcugcccgccucguccuggagcuacaucguggagacccccaacuccaagaacggcaucugcuaccccggcgacuucaucgacuacgaggagcuccgcgagcagcugagcuccgugucguccuucgagcgguucgagaucuucccgaaggagagcuccuggcccaagcacaacaccaccaagggggucacggccgccugcucgcacgcgggcaaguccagcuucuaccgcaaccugcucuggcugaccaagaaggaggacuccuaccccaagcugagcaacuccuacgugaacaagaaggggaaggaggugcucguccuguggggcgugcaccaccccucgaacagcaaggagcagcagacccuguaccagaacgagaacgccuacguguccgucgugucguccaacuacaaccggcgcuucaccccggagaucgccgagcggcccaaggugcgcgaccaggccgggcggaugaacuacuacuggacgcuccuggagcccggcgacaccaucaucuucgaggccaacggcaaccugaucgcgcccugguacgccuucgcccucagccgcggguucggcuccgggaucaucaccagcaacgccuccaugcacgagugcaacaccaagugccagacgccgcagggcgccaucaacucgucccugcccuuccagaacauccaccccgucaccaucggcgagugccccaaguacgucaagagcgcgaagcugcggauggugaccgggcuccgcaacaucccguccauccagucgcggggccuguucggggccaucgccggcuucaucgagggcggguggaccggcaugaucgacgggugguacggcuaccaccaccagaacgagcagggguccggcuacgccgccgaccagaaguccacgcagaacgcgaucaacgggaucaccaacaaggugaacagcgugaucgagaagaugaacacccaguucaccgccgugggcaaggaguucaacaaccuggagaagcgcauggagaaccucaacaagaaggucgacgacggcuuccuggacaucuggacguacaacgccgagcugcucgugcugcuggagaacgagcggacccucgacuuccacgacagcaacgugaagaaccuguacgagaaggucaagauccagcugaagaacaacgccaaggagaucgggaacggcugcuucgaguucuaccacaagugcgacaacgagugcauggaguccgugcgcaacgggaccuacgacuaccccaaguacucgaaggaguccaagcucaaccgggagaagaucgacggcgucaagcuggagcccauggggguguaccagauccuggccaucuacagcaccguggcgucgucccucguccugcuggugagccucggcgccaucuccuucuggaugugcagcaacggcucccugcagugccgcaucugcaucuga

SEQ ID NO: 10403 - RNA, 1701 nt, Artificial Sequence
  derived and/or modified CDS sequence (AUadapt) from InfluenzaA__AGQ47870__HA
augaaggccauccugcucgugcugcugugcaccuucgccgcgaccaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcugcucaccgugagcuccuggucguacaucgucgagaccuccaacagcgacaacggcacgugcuaccccggggacuucaucaacuacgaggagcugcgggagcagcuguccucgguguccagcuucgagcgcuucgagaucuuccccaagaccuccucguggcccaaccacgagaccaaccggggcgugaccgccgccugcccguacgccggggccaacuccuucuaccgcaaccucaucuggcuggucaagaagggcaacagcuaccccaagcuguccaagucguacgugaacaacaaggggaaggaggugcucguccuguggggcauccaccacccgcccacguccaccgaccagcagagccuguaccagaacgcggacgccuacguguucgugggcuccucgaaguacaaccggaaguucaagcccgagaucgccgcccgccccaagguccgggggcaggccggccgcaugaacuacuacuggacccucaucgagcccggggacaccaucacguucgaggcgaccggcaaccugguggugccccgguacgccuucgccaugaaccgcggcagcggguccggcaucaucaucucggacgccccgguccacgacugcaacaccaagugccagacccccaagggggccaucaacacgucccugcccuuccagaacauccaccccgugaccaucggcgagugcccgaaguacgucaagagcaccaagcuccggauggcgaccgggcugcgcaacauccccuccauccagucgcggggccuguucggcgccaucgccggguucaucgagggcggguggacgggcaugaucgacgggugguacggcuaccaccaccagaacgagcagggcuccggguacgccgccgaccagcgcagcacccagaacgcgaucgacggcaucaccaacaaggugaacuccgugaucgagaagaugaacacccaguucacggccguggggaaggaguucaaccaccucgagaagcggaucgagaaccugaacaagaaggucgacgacggcuuccuggacaucuggaccuacaacgccgagcuccuggugcugcucgagaacgagcgcacccuggacuuccacgacucgaacgucaagaaccuguacgagaaggugcggucccagcuccgcaacaacgccaaggagaucgggaacggcugcuucgaguucuaccacaagugcgacgacacgugcauggagagcgugaagaacggcaccuacgacuaccccaaguacuccgaggagucgaagcugaaccgggaggagaucgacggggucaagcuggaguccacccgcaucuaccagauccucgccaucuacagcaccguggcguccucgcuggugcugcucgucucccugggcgccaucagcuucuggaugugcagcaacgggucccugcagugccggaucugcaucuga

SEQ ID NO: 10404 - RNA, 1701 nt, Artificial Sequence
  derived and/or modified CDS sequence (AUadapt) from InfluenzaA__AGQ47882__HA
augaaggccauccugcucgugcugcugugcaccuucgccgcgaccaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcugcucaccgugagcuccuggucguacaucgucgagaccuccaacagcgacaacggcacgugcuaccccggggacuucaucaacuacgaggagcugcgggagcagcuguccucgguguccagcuucgagcgcuucgagaucuuccccaagaccuccucguggcccaaccacgagaccaaccggggcgugaccgccgccugcccguacgccggggccaacuccuucuaccgcaaccucaucuggcuggucaagaaggagaacagcuaccccaagcuguccaagucguacgugaacaacaagggcaaggaggugcucguccugugggggauccaccacccgcccacguccaccgaccagcagagccuguaccagaacgcggacgccuacguguucgugggcuccucgaaguacaaccggaaguucaagcccgagaucgccgcccgccccaagguccggggccaggccgggcgcaugaacuacuacuggacccucaucgagcccggcgacaccaucacguucgaggcgaccgggaaccugguggugccccgguacgccuucgccaugaaccgcggcagcggcuccgggaucaucaucucggacgccccgguccacgacugcaacaccaagugccagacccccaagggcgccaucaacacgucccugcccuuccagaacauccaccccgugaccaucggggagugcccgaaguacgucaagagcaccaagcuccggauggcgaccggccugcgcaacauccccuccauccagucgcgggggcuguucggcgccaucgccggcuucaucgagggcggguggacggggaugaucgacggcugguacggguaccaccaccagaacgagcagggcuccggcuacgccgccgaccagcgcagcacccagaacgcgaucgacgggaucaccaacaaggugaacuccgugaucgagaagaugaacacccaguucacggccgugggcaaggaguucaaccaccucgagaagcggaucgagaaccugaacaagaaggucgacgacggguuccuggacaucuggaccuacaacgccgagcuccuggugcugcucgagaacgagcgcacccuggacuuccacgacucgaacgucaagaaccuguacgagaaggugcggucccagcuccgcaacaacgccaaggagaucggcaacgggugcuucgaguucuaccacaagugcgacgacacgugcauggagagcgugaagaacggcaccuacgacuaccccaaguacuccgaggagucgaagcugaaccgggaggagaucgacggcgucaagcuggaguccacccgcaucuaccagauccucgccaucuacagcaccguggcguccucgcuggugcugcucgucucccugggggccaucagcuucuggaugugcagcaacggcucccugcagugccggaucugcaucuga

SEQ ID NO: 10405 - RNA, 1701 nt, Artificial Sequence; identical to SEQ ID NO: 9340
  derived and/or modified CDS sequence (AUadapt) from InfluenzaA__AGQ47894__HA

SEQ ID NO: 10406 - RNA, 1701 nt, Artificial Sequence
  derived and/or modified CDS sequence (AUadapt) from InfluenzaA__AGQ47906__HA
augaagaccaucaucgcccugucguacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagucguccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucucgaacugcuaccccuacgacgugccggacuacgcgucccuccgcagccuggucgccuccucgggcacccuggaguucaucaccgagggguucaccuggacgggcgugacccagaacgggggcuccaacgccugcaagcgggggcccggcagcggcuucuucucccgccucaacuggcugaccaagucgggguccaccuaccccgugcugaacgucacgaugcccaacaacgacaacuucgacaagcucuacaucuggggcauccaccacccgagcaccaaccaggagcagaccucccuguacgugcaggccucggggcgggugaccgucuccacgcgccggagccagcagaccaucauccccaacaucggcucgcgccccugggugcggggccuguccagccgcaucuccaucuacuggaccaucgugaagcccggggacguccucgugaucaacucgaacggcaaccugaucgcgccgcggggguacuucaagaugcgcaccggcaaguccagcaucaugcgguccgacgcccccaucgacacgugcaucucggagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucucggaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagucgggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 10407 - RNA, 1701 nt, Artificial Sequence
  derived and/or modified CDS sequence (AUadapt) from InfluenzaA__AGQ47918__HA
augaagaccaucaucgcccugucguacaucuucugccucgcccugggccaggaccugcccgggaacgacaacaacaccgcgacgcucugccugggccaccacgccgugccgaacgggacccuggucaagaccaucaccgacgaccagaucgaggugacgaacgccaccgagcucgugcaguccucguccaccggcaagaucugcaacaacccccaccgcauccuggacgggaucgacugcacccugaucgacgcccuccugggcgacccccacugcgacgucuuccagaacgagacgugggaccuguucguggagcggagcaaggccuucuccaacugcuaccccuacgacgugccggacuacgcgucgcuccgcucccuggucgccagcuccggcacccuggaguucaucaccgagggguucaccuggacgggcgugacccagaacgggggcucgaacgccugcaagcgggggcccggcuccggcuucuucagccgccucaacuggcugaccaaguccgggucgaccuaccccgugcugaacgucacgaugcccaacaacgacaacuucgacaagcucuacaucuggggcgugcaccacccguccaccaaccaggagcagaccagccuguacgugcaggccuccgggcgggucaccgugucgacgcgccggucccagcagaccaucauccccaacaucggcucgcgccccugggugcggggccugagcucccgcaucucgaucuacuggaccaucgucaagcccggggacgugcucgugaucaacuccaacggcaaccugaucgcgccgcggggguacuucaagaugcgcaccggcaagagcuccaucaugcggucggacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagucgacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagucgauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 10408 - RNA, 1701 nt, Artificial Sequence
  derived and/or modified CDS sequence (AUadapt) from InfluenzaA__AGQ47930__HA
augaaggccaaccugcucgugcugcugugcgcccucgcggccgccgacgccgacaccaucugcaucggcuaccacgccaacaacucgaccgacacggucgacaccgcgcuggagaagaacgugaccgugacccacuccgucaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucguggagacgcccaacuccgagaacggcaucugcuacccgggcgacuucaucgacuacgaggagcuccgcgagcagcugagcuccgucucguccuucgagcgguucgagaucuuccccaaggagagcuccuggcccaaccacaacaccaacaagggggugaccgccgccugcagccacgccggcaaguccucguucuaccgcaaccugcucuggcugaccgagaaggagggguccuaccccaagcugaagaacagcuacgugaacaagaagggcaaggagguccucgugcugugggggauccaccacccguccaacucgaaggaccagcagaaccuguaccagaacgagaacgccuacguguccgucgugacgagcaacuacaaccggcgcuucacccccgagaucgccgagcggcccaaggugcgcgaccaggccggccggaugaacuacuacuggacccuccugaagcccggcgacaccaucaucuucgaggcgaacgggaaccugaucgccccgauguacgccuucgcccucagccgcggcuucggguccggcaucaucacgucgaacgccuccaugcacgagugcaacaccaagugccagacgccccugggcgcgaucaacagcucccugcccuuccagaacauccaccccgucaccaucggggagugcccgaaguacgugcggucggccaagcuccgcauggugaccggccugcggaacauccccuccauccagagccgcgggcuguucggcgccaucgccggguucaucgagggcggcuggaccgggaugaucgacggcugguacggguaccaccaccagaacgagcagggcuccggguacgccgcggaccagaaguccacccagaacgccaucaacggcaucaccaacaaggucaacucggugaucgagaagaugaacauccaguucacggccgugggcaaggaguucaacaagcucgagaagcggauggagaaccugaacaagaaggucgacgacggguuccuggacaucuggaccuacaacgccgagcuccuggugcugcucgagaacgagcgcacccuggacuuccacgacagcaacgugaagaaccuguacgagaaggucaagucccagcucaagaacaacgccaaggagaucggcaacgggugcuucgaguucuaccacaagugcgacaacgagugcauggagagcgugcggaacggcaccuacgacuaccccaaguacuccgaggagucgaagcugaaccgcgagaaggucgacggggugaagcuggaguccaugggcaucuaccagauccucgcgaucuacagcacgguggccuccucgcugguccugcucgugagccugggcgccaucuccuucuggaugugcagcaacgggucccugcagugccggaucugcaucuga

SEQ ID NO: 10409 - RNA, 1698 nt, Artificial Sequence; identical to SEQ ID NO: 3523
  derived and/or modified CDS sequence (AUadapt) from InfluenzaA__AGQ47942__HA

SEQ ID NO: 10410 - RNA, 1698 nt, Artificial Sequence
  derived and/or modified CDS sequence (AUadapt) from InfluenzaA__AGQ47954__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggucguacaucgucgagacgcccaacuccgagaacggcaucugcuacccgggcgacuucaucgacuacgaggagcuccgcgagcagcugagcuccgugucguccuucgagcgguucgagaucuuccccaaggagagcuccuggcccaaccacaacaccaacggggugaccgccgccugcucgcacgagggcaaguccagcuucuaccgcaaccugcucuggcugaccgagaaggagggguccuaccccaagcugaagaacucguacgucaacaagaagggcaaggaggugcucgugcugugggggauccaccacccgcccaacuccaaggagcagcagaaccuguaccggaacgagaacgcguacgucagcguggugacguccaacuacaaccgccgguucacccccgagaucgccgagcgccccaagguccgggaccaggccggccgcaugaacuacuacuggacccuccugaagccgggcgacaccaucaucuucgaggccaacgggaaccugaucgcccccauguacgcguucgcccucucgcggggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgcuccgccaagcuccggauggucaccggccugcgcaacauccccucgauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacucgaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagucgaagcugaaccgggagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccgcaucugcaucuga

SEQ ID NO: 10411 - RNA, 1698 nt, Artificial Sequence
  derived and/or modified CDS sequence (AUadapt) from InfluenzaA__AGQ47966__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucgagaucuuccccaaggagagcuccuggcccgaccacaacaccaacggcgugaccgccgccugcucgcacgaggggaagaacuccuucuaccggaaccugcucuggcugaccgagaaggagagcuccuaccccaagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10412 - RNA, 1698 nt, Artificial Sequence
  derived and/or modified CDS sequence (AUadapt) from InfluenzaA__AGQ47978__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucgagaucuuccccaaggagagcuccuggcccgaccacaacaccaacggcgugaccgccgccugcucgcacgaggggaagaacuccuucuaccggaaccugcucuggcugaccaagaaggagagcuccuaccccgagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10413 - RNA, 1698 nt, Artificial Sequence
  derived and/or modified CDS sequence (AUadapt) from InfluenzaA__AGQ47990__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucaagaucuuccccaaggagagcuccuggcccgaccacaacaccaacggcgugaccgccgccugcucgcacgaggggaagaacuccuucuaccggaaccugcucuggcugaccaagaaggagagcuccuaccccgagcugaagaacucguacgucaacaagaagggcaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10414 - RNA, 1698 nt, Artificial Sequence
  derived and/or modified CDS sequence (AUadapt) from InfluenzaA__AGQ48002__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugggcuccuggucguacaucgucgagacgcccaacuccgagaacggcaucugcuacccgggggacuucaucgacuacgaggagcuccgggagcagcugagcuccgugucguccuucgagcgcuucaagaucuuccccaaggagagcuccuggcccgaccacaacaccaacggcgugaccgccgccugcucgcacgaggggaagaacuccuucuaccggaaccugcucuggcugaccaagaaggagagcuccuaccccgagcugaagaacucguacgucaacaagaagcgcaaggaggugcucgugcuguggggcauccaccacccgcccaacuccaaggagcagcagaaccuguaccagaacgagaacgcguacgucagcguggugacguccaacuacaaccggcgcuucacccccgagaucgccgagcggcccaaggucaaggaccaggccgggcgcaugaacuacuacuggacccuccugaagccgggcgacaccaucaucuucgaggccaacggcaaccugaucgcccccauguacgcguucgcccucucgcggggguucggcagcgggaucaucacguccaacgccucgaugcacgagugcaacaccaagugccagacgccccugggcgccaucaacuccagccugcccuaccagaacauccacccggugaccaucggcgagugccccaaguacgugcgcuccgccaagcuccggauggucaccgggcugcgcaacauccccucgauccagucccggggccuguucggggcgaucgccggcuucaucgagggcggguggaccggcaugaucgacgggugguacggcuaccaccaccagaacgagcaggggagcggcuacgccgccgaccagaaguccacccagaacgccaucaacgggaucaccaacaaggugaacacggugaucgagaagaugaacauccaguucaccgcggucggcaaggaguucaacaagcucgagaagcgcauggagaaccugaacaagaagguggacgacggcuuccuggacaucuggaccuacaacgccgagcuccuggugcugcucgagaacgagcggacccuggacuuccacgacucgaacgucaagaaccuguacgagaaggugaagucccagcucaagaacaacgccaaggagaucgggaacggcugcuucgaguucuaccacaagugcgacaacgagugcauggagagcguccgcaacgggacguacgacuaccccaaguacuccgaggagucgaagcugaaccgggagaagguggacggcgugaagcuggaguccauggggaucuaccagauccucgccaucuacagcaccgucgccuccucgcuggugcugcucgugucccugggcgcgaucagcuucuggaugugcagcaacggcucccugcagugccgcaucugcaucuga

SEQ ID NO: 10415 - RNA, 1698 nt, Artificial Sequence
  derived and/or modified CDS sequence (AUadapt) from InfluenzaA__AGQ48014__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccgggcugcgacccccugcugcccgugggcuccuggucguacaucgucgagacgcccaacuccgagaacgggaucugcuacccgggcgacuucaucgacuacgaggagcuccgggagcagcugagcuccgugucguccuucgagcgcuucaagaucuuccccaaggagagcuccuggcccgaccacaacaccaacggggugaccgccgccugcucgcacgagggcaagaacuccuucuaccggaaccugcucuggcugaccaagaaggagagcuccuaccccgagcugaagaacucguacgucaacaagaagcgcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaaggucaaggaccaggccggccgcaugaacuacuacuggacccuccugaagccgggcgacaccaucaucuucgaggccaacgggaaccugaucgcccccauguacgcguucgcccucucgcggggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgcuccgccaagcuccggauggucaccggccugcgcaacauccccucgauccagucccgggggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcgcauggagaaccugaacaagaagguggacgacggguuccuggacaucuggaccuacaacgccgagcuccuggugcugcucgagaacgagcggacccuggacuuccacgacucgaacgucaagaaccuguacgagaaggugaagucccagcucaagaacaacgccaaggagaucggcaacgggugcuucgaguucuaccacaagugcgacaacgagugcauggagagcguccgcaacggcacguacgacuaccccaaguacuccgaggagucgaagcugaaccgggagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccgcaucugcaucuga

SEQ ID NO: 10416 - RNA, 1698 nt, Artificial Sequence
  derived and/or modified CDS sequence (AUadapt) from InfluenzaA__AGQ48026__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggucguacaucgucgagacgcccaacuccgagaacgggaucugcuacccgggcgacuucaucgacuacgaggagcuccgcgagcagcugagcuccgugucguccuucgagcgguucaagaucuuccccaaggagagcuccuggcccgaccacaacaccaacggggugaccgccgccugcucgcacgagggcaagaacuccuucuaccgcaaccugcucuggcugaccaagaaggagagcuccuaccccgagcugaagaacucguacgucaacaagaagcggaaggaggugcucgugcugugggggauccaccacccgcccaacuccaaggagcagcagaaccuguaccagaacgagaacgcguacgucagcguggugacguccaacuacaaccgccgguucacccccgagaucgccgagcgccccaaggucaaggaccaggccggccggaugaacuacuacuggacccuccugaagccgggcgacaccaucaucuucgaggccaacgggaaccugaucgcccccauguacgcguucgcccucucgcgcggcuucgggagcggcaucaucacguccaacgccucgaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccucgauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagucgaagcugaaccgcgagaagguggacggggugaagcuggaguccaugggcaucuaccagauccucgccaucuacagcaccgucgccuccucgcuggugcugcucgugucccugggcgcgaucagcuucuggaugugcagcaacgggucccugcagugccggaucugcaucuga

SEQ ID NO: 10417 - RNA, 1698 nt, Artificial Sequence
  derived and/or modified CDS sequence (AUadapt) from InfluenzaA__AGQ48038__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggucguacaucgucgagacgcccaacuccgagaacgggaucugcuacccgggcgacuucaucgacuacgaggagcuccgcgagcagcugagcuccgugucguccuucgagcgguucaagaucuuccccaaggagagcuccuggcccgaccacaacaccaacggggugaccgccgccugcucgcacgagggcaagaacuccuucuaccgcaaccugcucuggcugaccaagaaggagagcuccuaccccgagcugaagaacucguacgucaacaagaagcgggaggaggugcucgugcugugggggauccaccacccgcccaacuccgaggagcagcagaaccuguaccagaacgagaacgcguacgucagcguggugacguccaacuacaaccgccgguucacccccgagaucgccgagcgccccaaggucaagggccaggccggccggaugaacuacuacuggacccuccugaagccgggggacaccaucaucuucgaggccaacggcaaccugaucgcccccauguacgcguucgcccucucgcgcggguucggcagcggcaucaucacguccaacgccucgaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccucgauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacacggugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucgggaacggcugcuucgaguucuaccacaagugcgacaacgagugcauggagagcguccggaacgggacguacgacuaccccaaguacuccgaggagucgaagcugaaccgcgagaagguggacggcgugaagcuggaguccaugggcaucuaccagauccucgccaucuacagcaccgucgccuccucgcuggugcugcucgugucccugggggcgaucagcuucuggaugugcagcaacggcucccugcagugccggaucugcaucuga

SEQ ID NO: 10418 - RNA, 1698 nt, Artificial Sequence
  derived and/or modified CDS sequence (AUadapt) from InfluenzaA__AGQ48050__HA
augaaggccaaccugcucgugcugcugugcgcccucgcggccgccgacgccgacaccaucugcaucggcuaccacgccaacaacucgaccgacacggucgacaccgugcuggagaagaacgugaccgucacccacuccgugaaccugcucgaggacagccacaacgggaagcugugcaagcugaagggcaucgcgccccuccagcuggggaagugcaacaucgccggcuggcugcucgggaacccgggcugcgacccccugcugcccgugggcuccuggucguacaucgucgagacgcccaacuccgagaacgggaucugcuacccgggcgacuucaucgacuacgaggagcuccgcgagcagcugagcuccgugucguccuucgagcgguucaagaucuuccccaaggagagcuccuggcccgaccacaacaccaacggggugaccgccgccugcucgcacgagggcaagaacuccuucuaccgcaaccugcucuggcugaccaagaaggagagcuccuaccccgagcugaagaacucguacgucaacaagaagcgggaggaggugcucgugcugugggggauccaccacccgcccgacuccgaggagcagcagaaccuguaccagaacgagaacgcguacgucagcguggugacguccaacuacaaccgccgguucacccccgagaucgccgagcgccccaaggucaagggccaggccggccggaugaacuacuacuggacccuccugaagccgggggacaccaucaucuucaaggccaacggcaaccugaucgcccccauguacgcguucgcccucucgcgcggguucggcagcggcaucaucacguccaacgccucgaugcacgagugcaacaccaagugccagacgccccugggggccaucaacuccagccugcccuaccagaacauccacccggugaccaucggcgagugccccaaguacgugcgguccgccaagcuccgcauggucaccgggcugcggaacauccccucgauccagucccgcggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacacggugaucgagaagaugaacauccaguucaccgcggucgggaaggaguucaacaagcucgagaagcggauggagaaccugaacaagaagguggacgacggcuuccuggacaucuggaccuacaacgccgagcuccuggugcugcucgagaacgagcgcacccuggacuuccacgacucgaacgucaagaaccuguacgagaaggugaagucccagcucaagaacaacgccaaggagaucgggaacggcugcuucgaguucuaccacaagugcgacaacgagugcauggagagcguccggaacgggacguacgacuaccccaaguacuccgaggagucgaagcugaaccgcgagaagguggacggcgugaagcuggaguccaugggcaucuaccagauccucgccaucuacagcaccgucgccuccucgcuggugcugcucgugucccugggggcgaucagcuucuggaugugcagcaacggcucccugcagugccggaucugcaucuga

SEQ ID NO: 10419 - RNA, 1689 nt, Artificial Sequence
  derived and/or modified CDS sequence (AUadapt) from InfluenzaA__AGQ80946__HA
auggccaucaucuaccugauccuccuguucaccgccgugcgcggcgaccagaucugcaucggguaccacucgaacaacuccaccgagaaggucgacacgauccuggagcggaacgugaccgugacccacgcgcaggacauccucgagaagacccacaacggcaagcugugcaagcugaacgggaucccgccccucgagcugggcgacugcucgaucgccggguggcugcucggcaaccccgagugcgaccgccugcugacgguccccgagugguccuacaucauggagaaggagaacccccggaacggccucugcuacccggggucguucaacgacuacgaggagcugaagcaccuccuguccucggugacccacuucgagaaggugaagauccugcccaaggaccgcuggacccagcacaccacgaccggcgggucccgggccugcgccgucucgggcaaccccuccuucuuccgcaacaugguguggcugaccaagaaggggcccaacuacccgguggccaagggcucguacaacaacaccuccggcgaccagaugcucaucaucuggggcguccaccaccccaacgacgaggcggagcagcggacgcuguaccagaacguggggaccuacgugucggucgggaccuccacccugaacaagcgcucggugcccgagaucgccacgcggcccaaggugaacggccagggcgggcgcauggaguucuccuggaccauccucgacguccuggacaccaucaacuucgagucgaccggcaaccugaucgccccggaguacggguucaagaucuccaagcggggcucguccgggaucaugaagacggagggcacccucgagaacugcgagaccaagugccagacgccccugggcgccaucaacaccacccugcccuuccacaacauccacccccucaccaucggggagugcccgaaguacgucaagucggagcgccuggugcuggcgaccggccuccggaacgugccccagaucgagucgcgcgggcuguucggcgccaucgccggguucaucgagggcggcuggcaggggaugguggacggcugguacggguaccaccacuccaacgaccagggcucgggguacgccgccgacaaggaguccacgcagaaggcgaucgacggcaucaccaacaaggugaacucggucaucgagaagaugaacacccaguucgaggccgugggcaaggaguucuccaaccuggagaagcggcucgagaaccugaacaagaagauggaggacggguuccuggacguguggaccuacaacgccgagcuccugguccugauggagaacgagcgcacgcucgacuuccacgacucgaacgugaagaaccuguacgacaagguccggaugcagcugcgcgacaacgccaaggagcucggcaacgggugcuucgaguucuaccacaagugcgacgacgagugcaugaacuccgugaagaacggcaccuacgacuaccccaaguacgaggaggagucgaagcugaaccggaacgagaucaagggcgugaagcuguccaacaugggggucuaccagauccucgccaucuacgcgaccguggccggcucgcugucccuggccaucaugaucgccgggaucucgcucuggaugugcuccaacggcucgcugcagugccgcaucugcaucuga

SEQ ID NO: 10420 - RNA, 1689 nt, Artificial Sequence
  derived and/or modified CDS sequence (AUadapt) from InfluenzaA__AGQ80947__HA
auggccaucaucuaccugauccuccuguucgccaccgugcgcggcgaccagaucugcaucggguaccacucgaacaacuccaccgagaaggucgacacgauccuggagcggaacaucaccgugacccacgcgcaggacauccucgagaagacccacaacggcaagcugugcaagcugaacgggaucccgccccucgagcugggcaacugcucgaucgccggguggcugcucggcaaccccgagugcgaccgccugcugacggugcccgagugguccuacaucauggagaaggagaacccccgggacggccucugcuacccggggucguucaacgacuacgaggagcugaagcaccuccuguccucggucacccacuucgagaaggugaagauccugcccaaggaccgcuggacccagcacaccacgaccggcgggucccgggccugcgccgugucgggcaaccccuccuucuuccgcaacauggucuggcugaccaagaaggggucgaacuaccccaucgccaagggcuccuacaacaacaccucgggcgagcagaugcucaucaucuggggcgugcaccacccgaacgacgacgcggagcagcggacgcuguaccagaacguggggaccuacgucuccguggggaccucgacccugaacaagcgcuccauccccgagaucgccacgcggcccaaggugaacggccagggcgggcgcauggaguucucguggaccauccucgacaugcuggacaccaucaacuucgaguccaccggcaaccugaucgcccccgaguacggguucaagaucucgaagcggggcuccucggggaucaugaagacggagggcacccucgagaacugcgagaccaagugccagaccccgcugggcgccaucaacacgacccugcccuuccacaacauccacccccucaccaucggggagugccccaaguacgucaagucggagcgccuggugcuggcgaccggccuccggaacgugccgcagaucgagucccgcgggcuguucggcgccaucgccggguucaucgagggcggcuggcaggggauggucgacggcugguacggguaccaccacucgaacgaccagggcuccggguacgccgccgacaaggagucgacgcagaaggcgaucgacggcaucaccaacaaggugaacuccgugaucgagaagaugaacacccaguucgaggccgucggcaaggaguucaacaaccuggagaagcggcucgagaaccugaacaagaagauggaggacggguuccuggacguguggaccuacaacgccgagcuccuggugcugauggagaacgagcgcacgcucgacuuccacgacucgaacgucaagaaccuguacgacaaggugcggaugcagcugaaggacaacgccaaggagcucggcaacgggugcuucgaguucuaccacaagugcgacgacgagugcaugaacuccgugaagaacggcaccuacgacuaccccaaguacgaggaggagucgaagcugaaccgcaacgagaucaagggcgucaagcuguccaacauggggguguaccagauccucgccaucuacgcgaccgucgccggcucgcugucccuggccaucaugaucgccggggugucgcucuggaugugcuccaacggcucgcugcagugccggaucugcaucuga

SEQ ID NO: 10421 - RNA, 1689 nt, Artificial Sequence
  derived and/or modified CDS sequence (AUadapt) from InfluenzaA__AGQ80948__HA
auggccaucaucuaccugauccuccuguucgccgcggugcgcggcgaccagaucugcaucggguaccacucgaacaacuccaccgagaaggucgacaccauccuggagcggaacgugacggugacccacgcccaggacauccucgagaagacccacaacggcaagcugugcaagcugaacgggaucccgccccucgagcugggcaacugcucgaucgccggguggcugcucggcaaccccgagugcgaccgccugcugaccguccccgagugguccuacaucauggagaaggagaacccccggaacggccucugcuacccggggucguucaacgacuacgaggagcugaagcaccuccuguccucggugacgcacuucgagaaggugaagauccugcccaaggaccgcuggacccagcacaccaccacgggcgggucccgggccugcgccgucuucggcaaccccucguucuuccgcaacaugguguggcugaccaagaagggguccaacuaccccaucgcgaagggcucguacaacaacaccuccggcgagcagaugcucaucaucuggggcgugcaccacccgaacgacgacgccgagcagcggacccuguaccagaacgucgggacguacgugucgguggggaccuccacccugaacaagcgcucgauccccgagaucgccacccggcccaaggucaacggccagggcgggcgcauggaguucuccuggacgauccucgacaugcuggacaccaucaacuucgagucgaccggcaaccugaucgcccccgaguacggguucaagaucuccaagcggggcucguccgggaucaugaagaccgagggcacgcucgagaacugcgagaccaagugccagaccccgcugggcgcgaucaacaccacgcugcccuuccacaacauccacccccucaccaucggggagugccccaaguacgucaagucggagcgccuggugcuggccaccggccuccggaacgugccgcagaucgagucgcgcgggcuguucggcgccaucgccggguucaucgagggcggcuggcaggggaugguggacggcugguacggguaccaccacuccaacgaccagggcucgggguacgccgcggacaaggaguccacccagaaggccaucgacggcaucacgaacaaggugaacucggucaucgagaagaugaacacccaguucgaggccgugggcaaggaguucaacaaccuggagaagcggcucgagaaccugaacaagaagauggaggacggguuccuggacguguggaccuacaacgccgagcuccugguccugauggagaacgagcgcacccucgacuuccacgacuccaacgugaagaaccuguacgacaagauccggaugcagcugaaggacaacgccaaggagcucggcaacgggugcuucgaguucuaccacaagugcgacgacgagugcaugaacucggugaagaacggcacguacgacuaccccaaguacgaggaggaguccaagcugaaccgcaacgagaucaagggcgucaagcugucgaacauggggguguaccagauccucgcgaucuacgccaccgucgccggcucccugucgcuggccaucaugaucgccgggaucucccucuggaugugcagcaacggcucccugcagugccggaucugcaucuga

SEQ ID NO: 10422 - RNA, 1689 nt, Artificial Sequence
  derived and/or modified CDS sequence (AUadapt) from InfluenzaA__AGQ80949__HA
auggccaucaucuaccugauccuccuguucgccgcggugcgcggcgaccagaucugcaucggguaccacucgaacaacuccaccgagaaggucgacaccauccuggagcggaacgugacggugacccacgcccaggacauccucgagaagacccacaacggcaagcugugcaagcugaacgggaucccgccccucgagcugggcgacugcucgaucgccggguggcugcucggcaaccccgagugcgaccgccugcugaccguccccgagugguccuacaucauggagaaggagaacccccggaacggccucugcuacccggggucguucaacgacuacgaggagcugaagcaccuccuguccucggugacgcacuucgagaaggugaagauccugcccaaggaccgcuggacccagcacaccaccacgggcgggucccgggccugcgccgucucgggcaaccccuccuucuuccgcaacaugguguggcugaccaagaaggggucgaacuaccccaucgcgaagggcuccuacaacaacaccucgggcgagcagaugcucaucaucuggggcgugcaccacccgaacgacgacgccgagcagcggacccuguaccagaacgucgggacguacguguccguggggaccucgacccugaacaagcgcuccauccccgagaucgccacccggcccaaggucaacggccagggcgggcgcauggaguucucguggacgauccucgacaugcuggacaccaucaacuucgaguccaccggcaaccugaucgcccccgaguacggguucaagaucucgaagcggggcuccucggggaucaugaagaccgagggcacgcucgagaacugcgagaccaagugccagaccccgcugggcgcgaucaacaccacgcugcccuuccacaacauccacccccucaccaucggggagugccccaaguacgucaagucggagcgccuggugcuggccaccggccuccggaacgugccgcagaucgagucccgcgggcuguucggcgccaucgccggguucaucgagggcggcuggcaggggaugguggacggcugguacggguaccaccacucgaacgaccagggcuccggguacgccgcggacaaggagucgacccagaaggccaucgacggcaucacgaacaaggugaacuccgucaucgagaagaugaacacccaguucgaggccgugggcaaggaguucaacaaccuggagaagcggcucgagaaccugaacaagaagauggaggacggguuccuggacguguggaccuacaacgccgagcuccugguccugauggagaacgagcgcacccucgacuuccacgacucgaacgugaagaaccuguacgacaagauccggaugcagcugaaggacaacgccaaggagcucggcaacgggugcuucgaguucuaccacaagugcgacgacgagugcaugaacuccgugaagaacggcacguacgacuaccccaaguacgaggaggagucgaagcugaaccgcaacgagaucaagggcgucaagcuguccaacauggggguguaccagauccucgcgaucuacgccaccgucgccggcucgcugucccuggccaucaugaucgccgggaucucgcucuggaugugcuccaacggcucgcugcagugccggaucugcaucuga

SEQ ID NO: 10423 - RNA, 1701 nt, Artificial Sequence
  derived and/or modified CDS sequence (AUadapt) from InfluenzaA__AGQ80950__HA
augaagaccaucaucgcccugucguacaucuucugccucgccuucggccagaaccugcccgggaacgacuccucgaccgcgacgcugugccucggccaccacgccgugcugaacgggaccaucgucaagaccaucaccgacgaccagaucgaggugacgaacgccaccgagcuggugcaguccagcuccaccggcaagaucugcaacaacccgcacaagauccucgacgggcgcgacugcacccugaucgacgcccugcucggcgacccccacugcgacgucuuccaggacgagacgugggaccuguucguggagcggucguccgccuucagcaacugcuaccccuacgacgugcccgacuacgcgucccugcgcucgcucgucgccuccagcggcacccuggaguucaucaccgagggguucaccuggacgggcgugucccagaacgggggcucgggggccugcaagcggggcccggccaacggcuucuucucccgccugaacuggcucaccaagagcgggaacgcguaccccgugcugaacgucaccaugcccaacuccgacaacuucgacaagcuguacaucuggggcgugcaccaccccucgaccaaccaggagcagacgaaccucuacgugcaggccuccgggcgggucaccgugagcacccgccggucgcagcagaccaucaucccgaacaucggcucccgccccugggugcggggccagagcgggcgcaucuccaucuacuggacgaucgucaagcccggcgacgugcuggugaucaacucgaacgggaaccugaucgcgccccggggcuacuucaagaugcgcaccgggaaguccagcaucaugcgguccgacgccccgaucgagaccugcaucucggagugcaucacccccaacggcuccauccccaacgacaagcccuuccagaacgucaacaagaucacguacggcgccugcccgaaguacgugaagcagaacacccucaagcuggccaccgggaugcgcaacgugcccgagaagcagacccggggccuguucggggccaucgccggcuucaucgagaacgggugggagggcaugaucgacggcugguacggguuccgccaccagaacagcgagggcacggggcaggccgccgaccucaaguccacccaggcggccaucgaccagaucaacggcaagcugaaccgggucaucgagaagaccaacgagaaguuccaccagaucgagaaggaguucucggagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagaagacccggcgccagcuccgggagaacgccgaggacaugggcaacggcugcuucaagaucuaccacaagugcgacaacgcgugcaucgaguccauccgcaacgggaccuacgaccacgacaucuaccgcgacgaggcccugaacaaccgguuccagaucaagggcguggagcucaagucgggguacaaggacuggauccuguggaucuccuucgccaucagcugcuuccugcugugcgucgugcuccugggcuucaucaugugggccugccagcgcggcaacauccggugcaacaucugcaucuga

SEQ ID NO: 10424 - RNA, 1695 nt, Artificial Sequence
  derived and/or modified CDS sequence (AUadapt) from InfluenzaA__AGQ80951__HA
augcugucgaucgugauccucuuccugcuggucgccgaguccucgucccagaacuacaccggcaaccccgugaucugcauggggcaccacgccguggcgaacggcaccauggucaagacgcucaccgacgaccagguggagguggucaccgcccaggagcugguggagucgcagaaccugccggagcucugccccucgccccugcgccugguggacgggcagaccugcgacaucaucaacggcgcccucgggucgcccggcugcgaccaccugaacggcgccgagugggacaucuucaucgagcggccgaacgccauggacacgugcuaccccuucgacguccccgacuaccagucccugcgcagcauccucgcgaacaacgggaaguucgaguucaucgccgaggaguuccagugguccaccgugaagcagaacggcaagucgggggccugcaagcgggccaacgugaacgacuucuucaaccgccugaacuggcuggucaaguccgacggcaacgcguacccccuccagaaccugaccaaggugaacaacggggacuacgcccggcuguacaucuggggcgugcaccacccgucgaccgacacggagcagaccaaccucuacaagaacaaccccggccgcgucaccguguccaccaagacgucgcagaccuccgugguccccaacaucgggucgcggcccugggugcgcggccaguccgggcggaucucguucuacuggaccaucguggagccgggcgaccugaucgucuucaacaccaucggcaaccugaucgcgccccgcgggcacuacaagcucaacucccagaagaaguccacgauccugaacaccgccacccccaucggcagcugcguguccaagugccacaccgacaaggggucgcuguccacgaccaagcccuuccagaacaucucgcggguggccaucggcgacugcccgaaguacgucaagcaggggucccucaagcuggccaccggcaugcgcaacauccccgagaaggccucgcggggccuguucggggccaucgccggcuucaucgagaacggguggcagggccucaucgacgggugguacggcuuccgccaccagaacgccgagggcaccgggacggcggccgaccugaaguccacccaggccgccaucgaccagaucaacggcaagcugaaccggcucaucgagaagaccaacgagaaguaccaccagaucgagaaggaguucgagcaggucgaggggcgcauccaggaccuggagaaguacguggaggacaccaagaucgaccuguggucguacaacgccgagcuccugguggcgcuggagaaccagcacacgaucgacgugaccgacuccgagaugaacaagcuguucgagcggguccgccggcagcuccgcgagaacgccgaggacaagggcaacgggugcuucgagaucuuccacaagugcgacaacaacugcaucgagucgauccggaacggcaccuacgaccacgacguguaccgcaacgaggccaucaacaaccgcuuccagauccagggcgugaagcugacccagggguacaaggacaucauccucuggaucuccuucagcaucuccugcuuccugcuggucgcccuccugcuggccuucauccucugggcgugccagaacggcaacauccggugccagaucugcaucuga

SEQ ID NO: 10425 - RNA, 1683 nt, Artificial Sequence
  derived and/or modified CDS sequence (AUadapt) from InfluenzaA__AGQ80953__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugugaccaguuccucgaguucuccgccgaccugaucaucgagcgccgggaggggagcgacguguguuaccccggcaaguucgucaacgaggaagcgcugcgccagauccuccgggaguccgggggcaucgacaaggagacgaugggguucaccuacagcggcauccgcaccaauggcgccaccuccgccugccggcgcagcggguccagcuucuacgccgagaugaaguggcugcuguccaacacggauaacgcggccuucccccagaccaccaagagcuacaagaacacccggaaggaccccgcccucaucaucuggggcauccaccauuccgggagcacgaccgagcagaccaagcuguacggcuccggcaacaagcugaucaccguggggagcuccaacuaccagcagaguuucgugcccucccccggcgcccgcccgcaggucaacgggcaaagcggccggaucgacuuccacuggcucaugcugaaccccaaugacacggugaccuucagcuucaacggggccuucaucgcgcccgaucgcgccuccuuccugcggggcaagagcaugggcauccaguccggggugcaggucgacgccaacugcgagggcgacugcuaucacaacgggggcaccaucaucagcaaccuccccuuccagaacaucaacucccgcgccguggggaaguguccgcgguacgugaagcaggagagccugcugcucgccaccggcaugaagaacguccccgagauccccaagggccgcgggcuguucggcgcgaucgccggguucaucgagaacggcugggaggggcugaucgauggcugguacggcuuccggcaccagaacgcccagggggaaggcacggccgccgacuacaaguccacccagagcgcgaucgaucagaucaccgggaagcucaaccgccugaucgagaagaccaaccagcaguucgagcugaucgacaacgaguucacggagguggagcggcagaucggcaaugugaucaacuggacccgcgacuccaugaccgaggucuggagcuacaacgccgagcuccugguggccauggagaaccagcacaccaucgaucuggccgacuccgaaaugaacaagcucuacgagcgcgugcggcgccagcugcgggagaacgccgaggaggacggcacggggugcuuugagaucuuccacaagugcgacgacgacugcauggcgaguauccgcaacaacaccuacgaccacuccaaguaccgggaggaggccaugcagaaucgcauccagaucgaccccgucaagcugagcuccggcuacaaggacgugauccucugguucagcuucggggccuccuguuucauccugcuggccaucgcgaugggccucgucuucaucugcgugaagaacgggaacaugcggugcaccaucugcaucuga

SEQ ID NO: 10426 - RNA, 1683 nt, Artificial Sequence; identical to SEQ ID NO: 10425
  derived and/or modified CDS sequence (AUadapt) from InfluenzaA__AGQ80954__HA

SEQ ID NO: 10427 - RNA, 1683 nt, Artificial Sequence; identical to SEQ ID NO: 10425
  derived and/or modified CDS sequence (AUadapt) from InfluenzaA__AGQ80955__HA

SEQ ID NO: 10428 - RNA, 1683 nt, Artificial Sequence; identical to SEQ ID NO: 10425
  derived and/or modified CDS sequence (AUadapt) from InfluenzaA__AGQ80956__HA

SEQ ID NO: 10429 - RNA, 1683 nt, Artificial Sequence; identical to SEQ ID NO: 10425
  derived and/or modified CDS sequence (AUadapt) from InfluenzaA__AGQ80957__HA

SEQ ID NO: 10430 - RNA, 1683 nt, Artificial Sequence; identical to SEQ ID NO: 10425
  derived and/or modified CDS sequence (AUadapt) from InfluenzaA__AGQ80958__HA

SEQ ID NO: 10431 - RNA, 1683 nt, Artificial Sequence
  derived and/or modified CDS sequence (AUadapt) from InfluenzaA__AGQ80959__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugugaccaguuccucgaguucagcgccgaccugaucaucgagcgccgggagggguccgacguguguuaccccggcaaguucgugaacgaggaggcccugcgccagauccuccgggagagcgggggcaucgacaaggaggcgaugggguucaccuacuccggcauccgcaccaauggcgccaccagcgccugccggcgcuccgggagcuccuucuacgccgagaugaaguggcugcugagcaauacggacaacgcggccuucccccagaugaccaaguccuacaagaacacccggaaggaccccgcccucaucaucuggggcauccaccauagcggguccaccgccgagcagacgaaacuguacggcagcggcaacaagcuggucaccgugggguccagcaacuaucagcaguccuucgugcccagccccggcgcccgcccgcaggucaacgggcaguccggccggaucgacuuccacuggcucaugcugaaccccaaugacaccgugaccuucagcuucaacggggcguucaucgcccccgaucgcgccagcuuccugcggggcaaguccaugggcauccagagcggggugcaggucgacgccaacugcgagggcgacuguuaccacgggggcgggacgaucaucuccaaccuccccuuccagaacaucgacagccgcgccgugggcaaguguccgcgguacgugaagcagaagucccugcugcucgcgaccggcaugaagaacguccccgagagccccaaggggcgcggccuguucggggccaucgccggcuucaucgagaacgggugggagggccugaucgauggcugguacggguuccggcaccagaacgcccagggcgaggggaccgccgcggacuacaaguccacccagagcgccaucgaucagaucacgggcaagcucaaccgccugaucgagaagaccaaccagcaauucgagcugaucgacaacgaguucaccgagguggagaagcagaucggcaaugugaucaacuggacccgggacuccaucacggaggucuggagcuacaacgccgagcuccugguggccauggagaaccagcacaccaucgaucuggccgacuccgagaugaacaagcucuacgagcgcgugaagcgccagcugcgggagaacgcggaggaggacgggaccggcugcuuugagaucuuccacaagugcgacgacgacugcauggccaguauccgcaacaacaccuacgaccacuccaaguaccgggaggaggccaugcagaaucgcauccagaucgaccccgucaagcugagcuccggguacaaggacgugauccucugguucagcuucggcgccuccuguuucauccugcuggcgaucgccauggggcucgucuucaucugcgugaagaacggcaacaugcggugcacgaucugcaucuga

SEQ ID NO: 10432 - RNA, 1683 nt, Artificial Sequence
  derived and/or modified CDS sequence (AUadapt) from InfluenzaA__AGQ80961__HA
augaauacccagauccugguguucgcccucgucgccaucauccccaccaacgcggacaagaucugccugggccaccacgccgugucgaaugggacgaaggugaacacccugaccgagcgcggcgucgagguggugaacgccaccgagacggucgagcggaccaacgugccgaagaucugcuccaaggggaagcgcaccguggaccucggccagugcgggcugcugggcaccaucacgggcccgccccagugcgaccaguuucucgaguucagcgccgaccugaucaucgagcggcgcgagggguccgacgucugcuaccccggcaaguucgugaacgaggagacccugcggcagauccuccgcgagagugggggcaucgacaaggagaccaugggguucaccuacuccggcauccggacgaacggcgccaccagcgcgugccgccgguccgggagcuccuucuaugccgagaugaaguggcugcugagcaacaccgacaacgccgccuucccgcagaugaccaaguccuacaagaacgcgcgcaaggaccccgcccucaucaucuggggcauccaucacagcggguccacgaccgagcagaccaagcuguacggcagcggcaacaagcugaucaccgugggguccagcaacuaccagcaguccuuuguccccagccccggcgcccggccccaggugaacgggcaguccggccgcaucgacuuccacuggcucaugcugaaccccaacgacacggugaccuuuagcuucaacggggccuucaucgcccccgaccgggcgugcuuccugcgcggcaagagcaugggcauccaguccgggguccagguggaugccagcugcgagggcgacugcuaccacuccgggggcaccaucaucagcaaucuccccuuccagaacaucaacucccgggccguggggaagugcccgcgcuacgucaagcaggagagccugaugcuggccaccggcaugaagaacgugcccgagauccccaagggccggggccucuucggggccaucgcgggguuuaucgagaacggcugggaggggcugaucgacggcugguacggcuuccgccaccagaacgcccagggggagggcacggccgccgacuacaaguccacccagagugccaucgaccagaucaccgggaagcugaaccggcucaucgagaagaccaaccagcaguucgagcugaucgacaacgaguucacggagguggagaagcagaucggcaacgucaucaauuggacccgcgacuccaugaccgagguguggagcuacaacgcggagcugcucguggccauggagaaccagcacaccaucgaccuggccgacuccgagaugaauaagcuguacgagcgggucaagcgccagcuccgcgagaacgccgaggaggacggcacggggugcuucgagaucuuccacaagugcgaugacgacugcauggccagcauccggaacaacaccuacgaccauuccaaguaccgcgaggaggcgaugcagaaccggaucaagaucgaccccgugaagcugagcuccggcuacaaggacgucauccugugguucagcuuuggggccuccugcuucauccuccuggccaucgccaugggccugguguucaucugcgugaagaacgggaacaugcgcugcaccaucugcaucuga

SEQ ID NO: 10433 - RNA, 1683 nt, Artificial Sequence; identical to SEQ ID NO: 10432
  derived and/or modified CDS sequence (AUadapt) from InfluenzaA__AGQ80962__HA

SEQ ID NO: 10434 - RNA, 1683 nt, Artificial Sequence
  derived and/or modified CDS sequence (AUadapt) from InfluenzaA__AGQ80964__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugugaccaguuccucgaguucagcgccgaccugaucaucgagcgccgggagggguccgacgugugcuaucccggcaaguucgugaacgaggaagcccugcgccagauccuccgggagagcgggggcaucgacaaggaggcgaugggguucaccuacuccggcauccgcaccaacggcgccaccagugccugccggcgcuccgggagcuccuucuacgccgagaugaaguggcugcugagcaacacggacaaugcggccuucccccagaugaccaaguccuacaagaacacccggaaggaccccgcccucaucaucuggggcauccaccacagcggguccaccgccgagcagacgaagcuguauggcagcggcaacaagcuggucaccgugggguccagcaacuaccagcaguccuucgugcccagccccggcgcccgcccgcaggucaaugggcaauccggccggaucgacuuccacuggcucaugcugaaccccaacgacaccgugaccuucaguuucaacggggcguucaucgcccccgaccgcgccagcuuccugcggggcaaguccaugggcauccagagcggggugcaggucgaugccgacugcgagggcgacugcuaccacuccgggggcacgaucaucagcaaucuccccuuccagaacaucgacucccgcgccguggggaagugcccgcgguacgugaagcagcgcagccugcugcucgcgaccggcaugaagaacguccccgagauccccaagggccgggggcuguuuggcgccaucgccggguucaucgagaacggcugggaggggcugaucgacggcugguacggcuuccgccaccagaacgcccagggggagggcaccgccgcggauuacaaguccacccaaagcgccaucgaccagaucacggggaagcucaaccggcugaucgagaagaccaaccagcaguucgagcugaucgacaaugaguucaccgagguggagaagcagaucggcaacgugaucaacuggacccgcgacuccaucacggaggucuggagcuacaacgccgagcuccugguggccauggagaaucagcacaccaucgaccuggccgacuccgagaugaacaaacucuacgagcgcgugaagcggcagcugcgcgagaacgcggaggaggacggcaccggguguuucgagaucuuccacaagugcgacgacgacuguauggccagcauccggaacaacaccuacgaccacuccaaguaccgcgaggaggccaugcagaaucggauccagaucgaccccgucaagcugagcuccggcuacaaggacgugauccucugguucagcuucggggccuccuguuucauccugcuggcgaucgccaugggccucgucuucaucugcgugaagaacgggaacaugcgcugcacgaucugcaucuga

SEQ ID NO: 10435 - RNA, 1683 nt, Artificial Sequence; identical to SEQ ID NO: 10425
  derived and/or modified CDS sequence (AUadapt) from InfluenzaA__AGQ80965__HA

SEQ ID NO: 10436 - RNA, 1683 nt, Artificial Sequence; identical to SEQ ID NO: 10425
  derived and/or modified CDS sequence (AUadapt) from InfluenzaA__AGQ80966__HA

SEQ ID NO: 10437 - RNA, 1683 nt, Artificial Sequence; identical to SEQ ID NO: 10425
  derived and/or modified CDS sequence (AUadapt) from InfluenzaA__AGQ80968__HA

SEQ ID NO: 10438 - RNA, 1683 nt, Artificial Sequence
  derived and/or modified CDS sequence (AUadapt) from InfluenzaA__AGQ80970__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagaaggccguggaccucggccagugcgggcugcugggcaccaucaccggcccgccccagugugaccaguuccucgaguucuccgccgaccugaucaucgagcggcgcgaggggagcgacguguguuaccccggcaaguucgucaacgaggaggcgcugcggcagauccuccgcgaguccgggggcaucgacaaggagacgaugggguucaccuacagcggcauccggaccaauggcgccaccuccgccugccgccggagcggguccagcuucuacgccgagaugaaguggcugcuguccaacacggauaacgcggccuucccccagaccaccaagagcuacaagaacacccgcaaggaccccgcccucaucaucuggggcauccaccauuccgggagcacgaccgaacagaccaagcuguacggcuccggcaacaagcugaucaccguggggagcuccaacuaccagcagaguuucgugcccucccccggcgcccggccgcaggucaacgggcagagcggccgcaucgacuuccacuggcucaugcugaaccccaaugacacggugaccuucagcuucaacggggccuucaucgcgcccgaucgggccuccuuccugcgcggcaagagcaugggcauccaguccggggugcaggucgacgccaacugcgagggcgacugcuaucacaacgggggcaccaucaucagcaaccuccccuuccagaacaucaacucccgggccguggggaaguguccgcgcuacgugaagcaggagagccugcugcucgccaccggcaugaagaacguccccgagauccccaagggccgggggcuguucggcgcgaucgccggguucaucgagaacggcugggaggggcugaucgauggcugguacggcuuccgccaccagaacgcccagggggagggcacggccgccgacuacaaguccacccagagcgcgaucgaucagaucaccgggaagcucaaccggcugaucgagaaaaccaaccagcaguucgagcugaucgacaacgaguucacggagguggagcgccagaucggcaaugugaucaacuggacccgggacuccaugaccgaggucuggagcuacaacgccgagcuccugguggccauggagaaccagcacaccaucgaucuggccgacuccgagaugaacaagcucuacgagcgcgugcgccggcagcugcgcgagaacgccgaggaggacggcacggggugcuuugagaucuuccacaagugcgacgacgacugcauggcgaguauccggaacaacaccuacgaccacuccaaguaccgcgaggaggccaugcagaaucggauccagaucgaccccgucaagcugagcuccggcuacaaggacgugauccucugguucagcuucggggccuccuguuucauccugcuggccaucgcgaugggccucgucuucaucugcgugaagaacgggaacaugcgcugcaccaucugcaucuga

SEQ ID NO: 10439 - RNA, 1683 nt, Artificial Sequence
  derived and/or modified CDS sequence (AUadapt) from InfluenzaA__AGQ80971__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagaagaccguggaccucggccagugcgggcugcugggcaccaucacgggcccgccccagugugaccaguuccucgaguucuccgccgaccugaucaucgagcggcgcgaggggagcgacguguguuaccccggcaaguucgucaacgaggaggcccugcggcagauccuccgcgaguccgggggcaucgacaaggagaccaugggguucaccuacagcggcauccggaccaauggcgcgacguccgccugccgccggagcggguccagcuucuacgccgagaugaaguggcugcuguccaacaccgauaacgccgcguucccccagaccaccaagagcuacaagaacacgcgcaaggaccccgcccucaucaucuggggcauccaccauuccgggagcaccaccgagcagaccaagcuguacggcuccggcaacaagcugaucacgguggggagcuccaacuaccagcagaguuucgugcccucccccggcgcccggccgcaggucaacgggcagagcggccgcaucgacuuccacuggcucaugcugaaccccaaugacaccgugaccuucagcuucaacggggccuucaucgcccccgaucgggcguccuuccugcgcggcaagagcaugggcauccaguccggggugcaggucgacgccaacugcgagggcgacugcuaucacaacgggggcaccaucaucagcaaccuccccuuccagaacaucaacucccgggccguggggaaguguccgcgcuacgugaagcaagagagccugcugcucgccacgggcaugaagaacguccccgagauccccaagggccgggggcuguucggcgccaucgcgggguucaucgagaacggcugggaggggcugaucgauggcugguacggcuuccgccaccagaacgcccagggggagggcaccgccgccgacuacaaguccacccagagcgccaucgaucagaucaccgggaagcucaaccggcugaucgagaagacgaaccagcaguucgagcugaucgacaacgaguucaccgagguggagcgccagaucggcaaugugaucaacuggacccgggacuccaugaccgaggucuggagcuacaacgcggagcuccugguggccauggagaaccagcacacgaucgaucuggccgacuccgagaugaacaagcucuacgagcgcgugcgccggcagcugcgcgagaacgccgaggaggacggcaccgggugcuuugagaucuuccacaagugcgacgacgacugcauggccaguauccggaacaacaccuacgaccacuccaaguaccgcgaggaggcgaugcagaaucggauccagaucgaccccgucaagcugagcuccggcuacaaggacgugauccucugguucagcuucggggccuccuguuucauccugcuggccaucgccaugggccucgucuucaucugcgugaagaacgggaacaugcgcugcaccaucugcaucuga

SEQ ID NO: 10440 - RNA, 1683 nt, Artificial Sequence
  derived and/or modified CDS sequence (AUadapt) from InfluenzaA__AGQ80974__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugugaccaguuccucgaguucuccgccgaccugaucaucgagcgccgggaagggagcgacguguguuaccccggcaaguucgucaacgaggaggcgcugcgccagauccuccgggaguccgggggcaucgacaaggagacgaugggguucaccuacagcggcauccgcaccaauggcgccaccuccgccugccggcgcagcggguccagcuucuacgccgagaugaaguggcugcuguccaacacggauaacgcggccuucccccagaccaccaagagcuacaagaacacccggaaggaccccgcccucaucaucuggggcauccaccauuccgggagcacgaccgagcaaaccaagcuguacggcuccggcaacaagcugaucaccguggggagcuccaacuaccagcagaguuucgugcccucccccggcgcccgcccgcaggucaacgggcagagcggccggaucgacuuccacuggcucaugcugaaccccaaugacacggugaccuucagcuucaacggggccuucaucgcgcccgaucgcgccuccuuccugcggggcaagagcaugggcauccaguccggggugcaggucgacgccaacugcgagggcgacugcuaucacaacgggggcaccaucaucagcaaccuccccuuccagaacaucaacucccgcgccguggggaaguguccgcgguacgugaagcaggaaagccugcugcucgccaccggcaugaagaacguccccgagauccccaagggccgcgggcuguucggcgcgaucgccggguucaucgagaacggcugggaggggcugguggauggcugguacggcuuccggcaccagaacgcccagggggagggcacggccgccgacuacaaguccacccagagcgcgaucgaucagaucaccgggaagcucaaccgccugaucgagaaaaccaaccagcaguucgagcugaucgacaacgaguucacggagguggagcggcagaucggcaaugucaucaacuggacccgcgacuccaugaccgagguguggagcuacaacgccgagcuccugguggccauggagaaccagcacaccaucgaucuggccgacuccgagaugaacaagcucuacgagcgcguccggcgccaacugcgggagaacgccgaggaggacggcacggggugcuuugagaucuuccacaagugcgacgacgacugcauggcgaguauccgcaacaacaccuacgaccacuccaaguaccgggaggaggccaugcagaaucgcauccagaucgaccccgugaagcugagcuccggcuacaaggacgucauccucugguucagcuucggggccuccuguuucauccugcuggccaucgcgaugggccucguguucaucugcgugaagaacgggaacaugcggugcaccaucugcaucuga

SEQ ID NO: 10441 - RNA, 1683 nt, Artificial Sequence
  derived and/or modified CDS sequence (AUadapt) from InfluenzaA__AGQ80977__HA
augaauacccaaauccuggcccucgcccuggcggccaucauccccaccaacgccgacaagaucugccugggccaccacgccgugaguaacgggacgaaggugaacacccucaccgagcgcggcguggagguggucaacgccaccgagacgguggagcggaccuccaucccgcgcaucugcagcaaggggaagcgggcgguggaccugggccagugugggcugcucggcaccaucaccggcccgccccagugcgaccaauuccuggaguucuccgccgaccugaucaucgagcgccgggaggggagugacgucugcuaccccggcaaguucgugaacgaggaggcccuccgccagauccugcgggaguccgggggcaucgacaaggagacgaugggguuuaccuacagcggcauccgcaccaacggcgccaccuccgcgugccggcgcagcggguccaguuucuacgccgaaaugaaguggcugcucuccaacacggacaacgccgccuucccgcagaccaccaagaguuacaagaacacccggaaggaccccgcccugaucaucuggggcgugcaccacuccgggaguacgaccgagcagaccaagcuguacggcuccggcaacaagcucaucaccgucgggagcuccaacuaccagcaaagcuuugugcccucccccggcgcgcgcccccaggugaacgggcagagcggccggaucgacuuccacuggcugaugcugaaucccaacgacacggucaccuucagcuucaacggggccuuuaucgcccccgaccgcgccuccuuccuccggggcaagagcaugggcauccaguccgggguccagguggacgccaacugugagggcgacugcuaccacaacgggggcaccaucaucagcaaucugcccuuccagaacaucaacucccgcgcgguggggaagugcccgcgguacgugaagcaggaaagucugcuccuggccaccggcaugaagaacgugcccgagauccccaagggccgcgggcuguucggcgccaucgccggguucaucgagaacggcugggaggggcucgucgacggcugguacggcuuucggcaccagaacgcccagggggagggcacggcggccgacuacaaguccacccagagcgccaucgaucaaaucaccgggaagcugaaccgccugaucgagaagaccaaccagcaguucgagcucaucgacaacgaguucacggagguggagcggcagaucggcaaugugaucaacuggacccgcgacuccaugaccgaagucuggagcuacaacgccgagcugcugguggccauggagaaucagcacaccaucgaccucgcggacuccgagaugaacaagcuguacgagcgcgugcggcgccagcugcgggagaacgccgaggaggauggcacggggugcuucgaaaucuuccacaagugcgaugacgacugcauggccagcauccgcaacaacaccuaugaccacuccaaguaccgggaggaggccaugcagaaccgcauccagaucgaccccgucaagcucaguuccggcuacaaggacgugauccugugguucagcuucggggcguccugcuuuauccugcucgccaucgccaugggccuggucuucaucugcgucaagagcgggaacaugcggugcaccaucugcaucuga

SEQ ID NO: 10442 - RNA, 1683 nt, Artificial Sequence
  derived and/or modified CDS sequence (AUadapt) from InfluenzaA__AGQ80978__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugugaccaguuccucgaguucuccgccgaccugaucaucgagcgccgggaagggagcgacgugugcuaucccggcaaguucgucaacgaggaggcgcugcgccagauccuccgggaguccgggggcaucgacaaggagacgaugggguucaccuacagcggcauccgcaccaacggcgccaccuccgccugucggcgcagcggguccagcuucuacgccgagaugaaguggcugcuguccaacacggacaacgcggccuuuccccagaccaccaagagcuacaagaacacccggaaggaccccgcccucaucaucuggggcauccaccacuccgggagcaucacggagcaaaccaagcuguauggcuccggcaacaagcugaucaccguggggagcuccaacuaccagcagagcuucgugcccucccccggcgcccgcccgcaggucaacgggcagaguggccggaucgacuuccacuggcucaugcugaaccccaacgacaccgugacguucaguuucaacggggccuucaucgcgcccgaccgcgccuccuuccugcggggcaagagcaugggcauccaguccggggugcaggucgacgccaauugcgagggcgacugcuaccacaacgggggcaccaucaucagcaaucuccccuuccagaacaucaacucccgcgccguggggaagugcccgcgguacgugaagcaggaaagccugcugcucgccaccggcaugaagaacguccccgagauccccaagggccgcgggcuguuuggcgcgaucgccggguucaucgagaacggcugggaggggcugguggacggcugguacggcuuccggcaccagaacgcccagggggagggcaccgccgccgauuacaaguccacgcagagcgcgaucgaccagaucaccgggaagcucaaccgccugaucgagaaaaccaaccagcaguucgagcugaucgacaaugaguucaccgagguggagcggcagaucggcaacgucaucaacuggacgcgcgacuccaugaccgagguguggagcuacaacgccgagcuccugguggccauggagaaucagcacaccaucgaccuggccgacuccgagaugaacaagcucuacgagcgcguccggcgccaacugcgggagaacgccgaggaggacggcaccggguguuucgagaucuuccacaagugcgacgacgacuguauggcgagcauccgcaacaacacguacgaccacuccaaguaccgggaggaggccaugcagaaucgcauccagaucgaccccgugaagcugagcuccggcuacaaggacgucauccucugguucagcuucggggccuccuguuucauccugcuggccaucgcgaugggccucguguucaucugcgugaagaacgggaacaugcggugcaccaucugcaucuga

SEQ ID NO: 10443 - RNA, 1683 nt, Artificial Sequence
  derived and/or modified CDS sequence (AUadapt) from InfluenzaA__AGQ80979__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugugaccaguuccucgaguucuccgccgaccugaucaucgagcgccgggaggggagcgacguguguuaccccggcaaguucgucaacgaggaagcgcugcgccagauccuccgggaguccgggggcaucgacaaggagacgaugggguucaccuacagcggcauccgcaccaauggcgccaccuccgccugccggcgcagcggguccagcuucuacgccgagaugaaguggcugcuguccaacacggauaacgcggccuucccccagaccaccaagagcuacaagaacacccggaaggaccccgcccucaucaucuggggcauccaccauuccgggagcacgaccgagcagaccaagcuguacggcuccggcaacaagcugaucaccguggggagcuccaacuaccagcagaguuucgugcccucccccggcgcccgcccgcaggucaacgggcaaagcggccggaucgacuuccacuggcucaugcugaaccccaaugacacggugaccuucagcuucaacggggccuucaucgcgcccgaucgcgccuccuuccugcggggcaagagcaucggcauccaguccggggugcaggucgacgccaacugcgagggcgacugcuaucacaacgggggcaccaucaucagcaaccuccccuuccagaacaucaacucccgcgccguggggaaguguccgcgguacgugaagcaggagagccugcugcucgccaccggcaugaagaacguccccgagauccccaagggccgcgggcuguucggcgcgaucgccggguucaucgagaacggcugggaggggcugaucgauggcugguacggcuuccggcaccagaacgcccagggggaaggcacggccgccgacuacaaguccacccagagcgcgaucgaucagaucaccgggaagcucaaccgccugaucgagaagaccaaccagcaguucgagcugaucgacaacgaguucacggagguggagcggcagaucggcaaugugaucaacuggacccgcgacuccaugaccgaggucuggagcuacaacgccgagcuccugguggccauggagaaccagcacaccaucgaucuggccgacuccgaaaugaacaagcucuacgagcgcgugcggcgccagcugcgggagaacgccgaggaggacggcacggggugcuuugagaucuuccacaagugcgacgacgacugcauggcgaguauccgcaacaacaccuacgaccacuccaaguaccgggaggaggccaugcagaaucgcauccagaucgaccccgucaagcugagcuccggcuacaaggacgugauccucugguucagcuucggggccuccuguuucauccugcuggccaucgcgaugggccucgucuucaucugcgugaagaacgggaacaugcggugcaccaucugcaucuga

SEQ ID NO: 10444 - RNA, 1683 nt, Artificial Sequence; identical to SEQ ID NO: 10440
  derived and/or modified CDS sequence (AUadapt) from InfluenzaA__AGQ80980__HA

SEQ ID NO: 10445 - RNA, 1683 nt, Artificial Sequence; identical to SEQ ID NO: 10425
  derived and/or modified CDS sequence (AUadapt) from InfluenzaA__AGQ80981__HA

SEQ ID NO: 10446 - RNA, 1683 nt, Artificial Sequence; identical to SEQ ID NO: 10425
  derived and/or modified CDS sequence (AUadapt) from InfluenzaA__AGQ80982__HA

SEQ ID NO: 10447 - RNA, 1683 nt, Artificial Sequence; identical to SEQ ID NO: 10425
  derived and/or modified CDS sequence (AUadapt) from InfluenzaA__AGQ80983__HA

SEQ ID NO: 10448 - RNA, 1683 nt, Artificial Sequence; identical to SEQ ID NO: 10425
  derived and/or modified CDS sequence (AUadapt) from InfluenzaA__AGQ80984__HA

SEQ ID NO: 10449 - RNA, 1683 nt, Artificial Sequence; identical to SEQ ID NO: 10425
  derived and/or modified CDS sequence (AUadapt) from InfluenzaA__AGQ80985__HA

SEQ ID NO: 10450 - RNA, 1683 nt, Artificial Sequence; identical to SEQ ID NO: 10425
  derived and/or modified CDS sequence (AUadapt) from InfluenzaA__AGQ80986__HA

SEQ ID NO: 10451 - RNA, 1683 nt, Artificial Sequence; identical to SEQ ID NO: 10425
  derived and/or modified CDS sequence (AUadapt) from InfluenzaA__AGQ80987__HA

SEQ ID NO: 10452 - RNA, 1683 nt, Artificial Sequence; identical to SEQ ID NO: 10425
  derived and/or modified CDS sequence (AUadapt) from InfluenzaA__AGQ80988__HA

SEQ ID NO: 10453 - RNA, 1683 nt, Artificial Sequence
  derived and/or modified CDS sequence (AUadapt) from InfluenzaA__AGQ80990__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgaagaucugcagcaaggggaagcgcgccguggaccucggccagugcgggcugcugggcaccaucaccggcccgccccagugugaccaguuccucgaguucuccgccgaccugaucaucgagcggcgcgaggggagcgacguguguuaccccggcaaguucgucaacgaggaggcgcugcggcagauccuccgcgaguccgggggcaucgacaaggagacgaugggguucaccuacagcggcauccggaccaauggcgccaccuccgccugccgccggagcggguccagcuucuacgccgagaugaaguggcugcuguccaacacggauaacgcggccuucccccagaccaccaagagcuacaagaacacccgcaaggaccccgcccucaucaucuggggcauccaccauuccgggagcacgaccgaacagaccaagcuguacggcuccggcaacaagcugaucaccguggggagcuccaacuaccagcagaguuucgugcccucccccggcgcccggccgcaggucaacgggcagagcggccgcaucgacuuccacuggcucaugcugaaccccaaugacacggugaccuucagcuucaacggggccuucaucgcgcccgaucgggccuccuuccugcgcggcaagagcaugggcauccaguccggggugcaggucgacgccaacugcgagggcgacugcuaucacaacgggggcaccaucaucagcaaccuccccuuccagaacaucaacucccgggccguggggaaguguccgcgcuacgugaagcaggagagccugcugcucgccaccggcaugaagaacguccccgagauccccaagggccgggggcuguucggcgcgaucgccggguucaucgagaacggcugggaggggcugaucgauggcugguacggcuuccgccaccagaacgcccagggggagggcacggccgccgacuacaaguccacccagagcgcgaucgaucagaucaccgggaagcucaaccggcugaucgagaaaaccaaccagcaguucgagcugaucgacaacgaguucacggagguggagcgccagaucggcaaugugaucaacuggacccgggacuccaugaccgaggucuggagcuacaacgccgagcuccugguggccauggagaaccagcacaccaucgaucuggccgacuccgagaugaacaagcucuacgagcgcgugcgccggcagcugcgcgagaacgccgaggaggacggcacggggugcuuugagaucuuccacaagugcgacgacgacugcauggcgaguauccggaacaacaccuacgaccacuccaaguaccgcgaggaggccaugcagaaucggauccagaucgaccccgucaagcugagcuccggcuacaaggacgugauccucugguucagcuucggggccuccuguuucauccugcuggccaucgcgaugggccucgucuucaucugcgugaagaacgggaacaugcgcugcaccaucugcaucuga

SEQ ID NO: 10454 - RNA, 1683 nt, Artificial Sequence; identical to SEQ ID NO: 10439
  derived and/or modified CDS sequence (AUadapt) from InfluenzaA__AGQ80991__HA

SEQ ID NO: 10455 - RNA, 1683 nt, Artificial Sequence
  derived and/or modified CDS sequence (AUadapt) from InfluenzaA__AGQ80992__HA
augaauacccaaauccugguguucgcccucgucgccaucauccccaccaacgcggacaagaucugccugggccaccacgccgugagcaaugggacgaaggugaacacccugaccgagcgcggcgucgagguggugaacgccaccgagacggucgagcggaccaacgugccgcgcaucugcuccaaggggaagcggaccguggaccucggccagugcgggcugcugggcaccaucacgggcccgccccagugcgaucaguuccucgaguucagcgccgaccugaucaucgagcgccgggagggguccgacgucugcuaccccggcaaguucaugaaugaggaggcccugcgccagauccuccgggagagcgggggcaucgacaaggagaccaugggguucaccuacuccggcauccgcaccaacggcgcgacgagcgccugccggcgcuccgggaguuccuucuacgccgagaugaaguggcugcugagcaacaccgacaacgccgcguucccccagaugaccaaguccuauaagaacacccggaaggaccccgcccucaucaucuggggcauccaccacagcggguccacgaccgagcagaccaagcuguacggcagcggcaacaagcugaucaccgugggguccaguaacuaccagcaguccuucgugcccagccccggcgcccgcccgcaggucaacgggcaguccggccggaucgacuuccauuggcucaugcugaaccccaacgacacggugaccuucagcuucaacggggccuucaucgcccccgaucgcgcgugcuuccugcggggcaagagcaugggcauccaguccggggugcaggucgacgccagcugcgagggcgacuguuaccacuccgggggcaccaucaucagcaaccuccccuuccagaacaucaacucccgcgccguggggaaguguccgcgguacgugaagcaggagagccugaugcuggccaccggcaugaagaacguccccgagauccccaagggccgcggccucuucggggccaucgcgggguucaucgagaacggcugggaggggcugaucgacggcugguacggcuuucggcaccagaacgcccagggggagggcacggccgccgacuacaaguccacccagagcgccaucgaccagaucaccgggaagcugaaccgccucaucgagaagaccaaucagcaguucgagcugaucgacaacgaguucacggagguggagaagcagaucggcaacgugaucaacuggacccgggacuccaugaccgaggucuggagcuauaacgcggagcugcucguggccauggagaaccagcacaccaucgaccuggccgacuccgagaugaacaagcuguacgagcgcgugaagcgccagcuccgggagaaugccgaggaggacggcacggggugcuucgagaucuuccacaagugcgacgaugacugcauggccagcauccgcaacaacaccuacgaccacuccaaguaucgggaggaggcgaugcagaaccgcauccagaucgaccccgucaagcugagcuccggcuacaaggacgugauccugugguucagcuuuggggccuccugcuucauccuccuggccaucgccaugggccuggucuucaucugcgugaagaacgggaacaugcggugcaccaucugcaucuga

SEQ ID NO: 10456 - RNA, 1683 nt, Artificial Sequence; identical to SEQ ID NO: 10425
  derived and/or modified CDS sequence (AUadapt) from InfluenzaA__AGQ80993__HA

SEQ ID NO: 10457 - RNA, 1683 nt, Artificial Sequence; identical to SEQ ID NO: 10432
  derived and/or modified CDS sequence (AUadapt) from InfluenzaA__AGQ80994__HA

SEQ ID NO: 10458 - RNA, 1683 nt, Artificial Sequence; identical to SEQ ID NO: 10434
  derived and/or modified CDS sequence (AUadapt) from InfluenzaA__AGQ80995__HA

SEQ ID NO: 10459 - RNA, 1683 nt, Artificial Sequence; identical to SEQ ID NO: 10434
  derived and/or modified CDS sequence (AUadapt) from InfluenzaA__AGQ80996__HA

SEQ ID NO: 10460 - RNA, 1683 nt, Artificial Sequence
  derived and/or modified CDS sequence (AUadapt) from InfluenzaA__AGQ80997__HA
augaauacccagauccugguguucgcccucgucgccaucauccccaccaacgcggacaagaucugccugggccaccacgccgugagcaaugggacgaaggugaacacccugaccgagcgcggcgucgagguggugaacgccaccgagacggucgagcggaccaacaucccgcgcaucugcuccaaggggaagcggaccguggaccucggccagugcgggcugcugggcaccaucacgggcccgccccagugcgaucaguuccucgaguucagcgccgaccugaucaucgagcgccgggagggguccgacgugugcuaccccggcaaguuugucaacgaggaggcccugcgccagauccuccgggagagcgggggcaucgacaaggagaccaugggguucaccuacuccggcauccgcaccgacggcgcgacgagcgccugucggcgcuccgggagcuccuucuacgccgagaugaaguggcugcugagcaacaccgacaacgccgcguuuccccagaugaccaaguccuacaagaacacccggaaggaccccgcccucaucaucuggggcauccaccacagcggguccacgaccgagcagaccaagcuguacggcaguggcaacaagcugaucaccgugggguccagcaacuaccagcaguccuucgugcccagccccggcgcccgcccgcaggucaacgggcaguccggccggaucgauuuccacuggcucaugcugaaccccaacgacacggugaccuucagcuuuaacggggccuucaucgcccccgaccgcgcgagcuuccugcggggcaaguccaugggcauccagagcggggugcaggucgacgccaauugcgagggcgacugcuaccacuccgggggcaccaucaucagcaaccuccccuuucagaacaucaacucccgcgccguggggaagugcccgcgguacgugaagcaggagagccugcugcucgccaccggcaugaagaacguccccgagauccccaagggccgcgggcuguucggcgccaucgcgggguuuaucgagaacggcugggaggggcugaucgacggcugguacggcuuccggcaccagaacucccagggggagggcacggccgccgacuauaagagcacccaguccgccaucgaccagaucaccgggaagcucaaccgccugaucgagaagaccaaccagcaguucgagcugaucgacaacgaguuuacggagguggagaagcagaucggcaacgugaucaacuggacccgggacagcaugaccgaggucugguccuacaacgccgagcuccugguggcgauggagaaccagcauaccaucgaccuggccgacagcgagaugaacaagcucuacgagcgcgugaagcgccagcugcgggagaacgccgaggaggacggcacgggguguuucgagaucuuccacaagugcgacgacgacuguauggccuccauccgcaacaacaccuacgaccacagcaaguaccgggaggaggccaugcagaaucgcauccagaucgaccccgucaagcuguccagcggcuacaaggacgugauccucugguucuccuucggggcgagcuguuucauccugcuggccaucgccaugggccucgucuucaucugcgugaagaacgggaacaugcggugcaccaucugcaucuga

SEQ ID NO: 10461 - RNA, 1683 nt, Artificial Sequence
  derived and/or modified CDS sequence (AUadapt) from InfluenzaA__AGQ81000__HA
augaauacccagauccugguguucgcccucgucgccaucauccccaccaacgcggacaagaucugccugggccaccacgccgugucgaaugggacgaaggugaacacccugaccgagcgcggcgucgagguggugaacgccaccgagacggucgagcggaccaacaucccgcgcaucugcuccaaggggaagcggaccguggaccucggccagugcgggcugcugggcaccaucacgggcccgccccagugcgaucaguuccucgaguucagcgccgaccugaucaucgagcgccgggagggguccgacgugugcuaccccggcaaguucgucaaugaggaggcccugcgccagauccuccgggagagcgggggcaucgggaaggagaccaugggcuucaccuacuccggcauccgcaccaacggggcgacgagcgccugccggcgcuccggcagcuccuuuuacgccgagaugaaguggcugcugagcaacaccgacaacgccgcguucccccagaugaccaaguccuacaagaauacccggaaggaccccgcccucaucaucugggggauccaccacagcggcuccacgaccgagcagaccaagcuguacggcagcgggaacaagcugaucaccgugggcuccagcaauuaccagaaguccuucgugcccagccccggggcccgcccgcaggucaacggccaguccgggcggaucgacuuccacuggcucaugcugaaucccaacgacacggugaccuucucguucaacggcgccuucaucgcccccgaccgcgcgaguuuccugcggggcaaguccauggggauccagagcggcgugcaggucgacgccaacugcgagggggacugcuaucacaacggcgggaccaucaucuccaaccuccccuuccagaacaucaacagccgcgccgugggcaaguguccgcgguacgugaagcaggagucccugcugcucgccaccggcaugaagaacguccccgagauccccaaggggcgcggccuguucggggccaucgcgggcuucaucgagaacgggugggagggccugaucgacggcugguacggguuccggcaucagaacgcccagggcgaggggacggccgccgacuacaagagcacccaguccgccaucgaccagaucaccggcaagcucaaccgccugaucgagaagaccaaccagcaguuugagcugaucgacaacgaguucacggagguggagaagcagaucggcaacgugaucaacuggacccgggacagcaugaccgaggucugguccuacaaugcggagcuccugguggccauggagaaccagcacaccaucgaccuggccgacagcgagaugaacaagcucuacgagcgcgugaagcgccagcugcgggagaaugccgaggaggacgggacgggcugcuucgagaucuuccacaagugcgacgaugacugcauggccuccauccgcaacaacaccuacgaccacagcaaguaucgggaggaggcgaugcagaaccgcauccagaucgaccccgucaagcuguccagcggguacaaggacgugauccucugguucuccuucggcgccaguugcuucauccugcuggccaucgccauggggcucgucuucaucugcgugaagaacggcaacaugcggugcaccaucugcaucuga

SEQ ID NO: 10462 - RNA, 1683 nt, Artificial Sequence
  derived and/or modified CDS sequence (AUadapt) from InfluenzaA__AGQ81001__HA
augaauacccagauccugguguucgcccucgucgccaucauccccaccaacgcggacaagaucugccugggccaccacgccgugucgaaugggacgaaggugaacacccugaccgagcgcggcgucgagguggugaacgccaccgagacggucgagcggaccaacaucccgcgcaucugcuccaaggggaagcggaccguggaccucggccagugcgggcugcugggcaccaucacgggcccgccccagugcgaccaguuucucgaguucagcgccgaccugaucaucgagcgccgggagggguccgacgugugcuaccccggcaaguucgucaacgaggaggcccugcgccagauccuccgggagagugggggcaucgacaaggagaccaugggguucaccuacuccggcauccgcaccaacggcgcgacgagcgccugccggcgcuccgggagcuccuucuaugccgagaugaaguggcugcugagcaacaccgacaacgccgcguucccccagaugaccaaguccuacaagaacacccggaaggaccccgcccucaucaucuggggcauccaucacucgggguccacgaccgagcagaccaagcuguacggcagcggcaacaagcugaucaccguggggacguccaacuaccagcagagcuuugugcccucccccggcgcccgcccgcaggucaacgggcagagcggccggaucgacuuccacuggcucaugcugaaccccaacgacaccgugaccuuuuccuucaacggggccuucaucgcccccgaccgcgcgagcuuccugcggggcaagagcaugggcauccaguccggggugcaggucgacgccaauugcgagggcgacugcuaccacaacgggggcaccaucaucucgaaucuccccuuccagaacaucaacucccgcgccguggggaagugcccgcgguacgugaagcaggagagccugcugcucgccacgggcaugaagaacguccccgagauccccaagggccgcgggcuguucggcgccaucgcgggguuuaucgagaacggcugggaggggcugaucgacggcugguacggcuuccggcaccagaacgcccagggggagggcaccgccgccgacuacaaguccacccagagugccaucgaccagaucaccgggaagcucaaccgccugaucgagaagacgaaccagcaguucgagcugaucgacaacgaguucaccgagaucgagaagcagaucggcaacgugaucaauuggacccgggacuccaugaccgagguguggagcuacaacgcggagcuccuggucgccauggagaaccagcacacgaucgaccuggccgacuccgagaugaauaagcucuacgagcgcgugaagcgccagcugcgggagaacgccgaggaggacggcaccgggugcuucgagaucuuccacaagugcgaugacgacugcauggccagcauccgcaacaacaccuacgaccauuccaaguaccgggaggaggcgaugcagaaccgcauccagaucgaccccgugaagcugagcuccggcuacaaggacgucauccucugguucagcuuuggggccuccugcuucauccugcuggccaucgccaugggccucguguucaucugcgucaagaacgggaacaugcggugcaccaucugcaucuga

SEQ ID NO: 10463 - RNA, 1683 nt, Artificial Sequence; identical to SEQ ID NO: 10440
  derived and/or modified CDS sequence (AUadapt) from InfluenzaA__AGQ81002__HA

SEQ ID NO: 10464 - RNA, 1683 nt, Artificial Sequence; identical to SEQ ID NO: 10440
  derived and/or modified CDS sequence (AUadapt) from InfluenzaA__AGQ81003__HA

SEQ ID NO: 10465 - RNA, 1683 nt, Artificial Sequence; identical to SEQ ID NO: 10440
  derived and/or modified CDS sequence (AUadapt) from InfluenzaA__AGQ81004__HA

SEQ ID NO: 10466 - RNA, 1683 nt, Artificial Sequence; identical to SEQ ID NO: 10440
  derived and/or modified CDS sequence (AUadapt) from InfluenzaA__AGQ81005__HA

SEQ ID NO: 10467 - RNA, 1683 nt, Artificial Sequence; identical to SEQ ID NO: 10440
  derived and/or modified CDS sequence (AUadapt) from InfluenzaA__AGQ81006__HA

SEQ ID NO: 10468 - RNA, 1683 nt, Artificial Sequence; identical to SEQ ID NO: 10440
  derived and/or modified CDS sequence (AUadapt) from InfluenzaA__AGQ81007__HA

SEQ ID NO: 10469 - RNA, 1683 nt, Artificial Sequence; identical to SEQ ID NO: 10440
  derived and/or modified CDS sequence (AUadapt) from InfluenzaA__AGQ81008__HA

SEQ ID NO: 10470 - RNA, 1683 nt, Artificial Sequence
  derived and/or modified CDS sequence (AUadapt) from InfluenzaA__AGQ81009__HA
augaauacccaaauccugguguucgcccucgucgccaucauccccaccaacgcggacaagaucugccugggccaccacgccgugaguaacgggacgaaggugaacacccugaccgagcgcggcgucgagguggugaacgccaccgagacggucgagcggaccuccaucccgcgcaucugcagcaaggggaagcgggccguggaccucggccagugcgggcugcugggcaccaucaccggcccgccccagugugaccaguuccucgaguucuccgccgaccugaucaucgagcgccaggaggggagcgacguguguuaccccggcaaguucgucaacgaggaggcgcugcggcagauccuccgcgaguccgggggcaucaacaaggaaacgaugggguucaccuacagcggcauccggaccaauggcgccaccuccgccugccgccggagcggguccagcuucuacgccgagaugaaguggcugcuguccaacacggauaacgcggccuucccccagaccaccaagagcuacaagaacacccgcaaggaccccgcccucaucaucuggggcauccaccauuccgggagcacgaccgagcagaccaagcuguacggcuccggcaacaagcugaucaccguggggagcuccaacuaccagcagaguuucgugcccucccccggcgcccggccgcaggucaacgggcagagcggccgcaucgacuuccacuggcucaugcugaaccccaaugacacggugaccuucagcuucaacggggccuucaucgcgcccgaucgggccuccuuccugcgcggcaagagcaugggcauccaguccggggugcaggucgacgccaacugcgagggcgacugcuaucacaacgggggcaccaucaucagcaaccuccccuuccagaacaucaacucccgggccguggggaaguguccgcgcuacgugaagcaagagagccugcugcucgccaccggcaugaagaacguccccgagauccccaagggccgggggcuguucggcgcgaucgccggguucaucgagaacggcugggaggggcugguggauggcugguacggcuuccgccaccagaacgcccagggggagggcacggccgccgacuacaaguccacccagagcgcgaucgaucagaucaccgggaagcucaaccggcugaucgagaagaccaaccagcaguucgagcugaucgacaacgaguucacggagguggagcgccaaaucggcaaugucaucaacuggacccgggacuccaugaccgagguguggagcuacaacgccgagcuccugguggccauggagaaccagcacaccaucgaucuggccgacuccgagaugaacaagcucuacgagcgcguccgccggcagcugcgcgagaacgccgaggaggacggcacggggugcuuugagaucuuccacaagugcgacgacgacugcauggcgaguauccggaacaacaccuacgaccacuccaaguaccgcgaggaggccaugcagaaucggauccagaucgaccccgugaagcugagcuccggcuacaaggacgucauccucugguucagcuucggggccuccuguuucauccugcuggccaucgcgaugggccucguguucaucugcgugaagaacgggaacaugcgcugcaccaucugcaucuga

SEQ ID NO: 10471 - RNA, 1683 nt, Artificial Sequence
  derived and/or modified CDS sequence (AUadapt) from InfluenzaA__AGQ81011__HA
augaauacccaaauccugguguucgcccucaucgccaucacccccacgaacagcgacaagaucugccugggccaccaugcggucuccaacgggaccaaggugaacacccugaccgagcgcggcguggaggucgugaacgccacggagaccguggagcggaccagcaucccgcgcaucugcuccaaggggaagcggaccgucgaccucggccagugcgggcugcugggcacgaucaccggcccgccccagugugaccaguuccucgaguucagcgccgaccugaucaucgagcgccgggagggguccgacgugugcuaucccggcaaguucgugaacgaggaggcccugcgccagauccuccgggagagcgggggcaucgacaaggaggccaugggguucaccuacuccggcauccgcaccaacggcgcgacgagugccugccggcgcuccgagagcuccuucuacgccgagaugaaguggcugcugagcaacaccgacaaugccgcguucccgcccaugaccaaguccuacaagaacacccggaaggcccccgcccucaucaucugggggauccaccacagcggcuccacggccgagcagaccaagcuguacgggaguggcaacaagcuggucaccgugcgcuccagcaacuaccagcaguccuucgugcccagccccggcgccgggcccaaggucaauggccagagcgggcggaucgacuuccacuggcucaugcugaaccccaacgacaccgugacguuuuccuucaacggcgcguucaucgcccccgaccgcgccagcuuccugcgggggaaguccaugggcauccagagcggcgugcaggucgaugccaacugcgagggggacugcuaccacuccggcgggaccaucaucagcaaucucccguuccagaacaucgacucccgcguggugggcaagugcccccgguacgucaagcagaagucccugcugcucgccaccgggaugaaaaacgugcccgagauccccaagggccgcggccuguucggggcgaucgccggcuuuaucgagaacgggugggagggccugaucgacgggugguacggcuuccggcaccagaacgcccagggcgaggggaccgccgccgacuauaagagcacgcagagcgcgaucaaccagaugaccggcaagcucaaccgccugaucgagaagaccaaccagcaguucgagcugaucgauaacgaguucaccgagguggagaagcagaucgggaacgucaucaacuggacgcgggacuccaucaccgagguguggagcuacaaugccgagcuccugguggccauggagaaccagcacaccaucgaccuggccgacuccgagaugaacaagcucuacgagcgcgucaagcgccagcugcgggagaacgccgaggaggauggcaccggcugcuucgagaucuuccacaagugcgacgacgauugcauggcgagcauccgcaacaacacguacgaccacuccaaguaucgggaggaggccaugcagaaccgcauccagaucgacccggugaagcugagcuccggguacaaggacgucauccucugguucagcuuuggcgccuccugccugauccugcucgccaucgcgauggggcugguguucaucugcgugaagaacggcaacaugcggugcaccaucugcaucuga

SEQ ID NO: 10472 - RNA, 1683 nt, Artificial Sequence
  derived and/or modified CDS sequence (AUadapt) from InfluenzaA__AGQ81012__HA
augaauacccaaauccugguguucgcccucaucgccaucauccccaccaacagcgacaagaucugccugggccaccacgcggucuccaaugggacgaaggugaacacccugaccgagcgcggcguggaggucgugaacgccaccgagacgguggagcggaccagcaucccgcgcaucugcuccaaggggaagcggaccgucgaccucggccagugcgggcugcugggcaccaucacgggcccgccccagugcgaccaguuucucgaguucagcgccgaccugaucaucgagcgccgggagggguccgacgugugcuaccccggcaaguucgugaacgaggaggcccugcgccagauccuccgggagagugggggcaucaacaaggaggccaugggguucaccuacuccggcauccgcaccaacggcgcgaccagcgccugccggcgcuccgggagcuccuucuaugccgagaugaaguggcugcugagcaacacggacaacgccgcguucccgcccaugaccaaguccuacaagaacacccggaaggcccccgcccucaucaucuggggcauccaccauagcggguccaccgccgagcagacgaaacuguacggcagcggcaacaagcuggucaccgugcgcuccagcaacuaccagcaguccuuugugcccagccccggggccggcccccaggucaacgggcagagcggccggaucgacuuccacuggcucaugcugaaccccaacgauaccgugaccuucuccuucaacggggcguucaucgcccccgaccgcgccagcuuccugcggggcaaguccaugggcauccagagcggggugcaggucgaugccaacugcgagggcgacugcuaccacuccgggggcacgaucaucagcaaccucccguuucagaacaucgacucccgcgugguggggaagugcccccgguacgucaagcagaagucccugcugcucgccaccggcaugaagaacgugcccgagauccccaagggccgcgggcuguucggcgcgaucgccggguucaucgagaacggcugggaggggcugaucgauggcugguacggcuuccggcaccagaacgcccagggggagggcaccgccgccgacuacaagagcacccagagcgcgaucaaucagaugacggggaagcucaaccgccugaucgagaagaccaaccagcaauucgagcugaucgacaacgaguucaccgagguggagaagcagaucggcaacgucaucaauuggacccgggacuccaucacggagguguggagcuacaacgccgagcuccugguggccauggagaaccagcacaccaucgaccuggccgacuccgagaugaauaagcucuacgagcgcgucaagcgccagcugcgggagaacgccgaggaggacggcaccgggugcuucgagaucuuccacaagugcgaugacgacugcauggcgagcauccgcaacaacaccuacgaccauuccaaguaccgggaggaggccaugcagaaccgcauccagaucgacccggugaagcugagcuccggcuacaaggacgucauccucugguucagcuuuggggccuccugcuucauccugcuggccaucgcgaugggccucguguucaucugcgugaagaacgggaacaugcggugcacgaucugcaucuga

SEQ ID NO: 10473 - RNA, 1683 nt, Artificial Sequence
  derived and/or modified CDS sequence (AUadapt) from InfluenzaA__AGQ81017__HA
augaauacccaaauccugguguucgcccucaucgccaucacccccacgaacagcgacaagaucugccugggccaccacgcggucuccaaugggaccaaggugaacacccugaccgagcgcggcguggaggucgugaacgccacggagaccguggagcggaccagcaucccgcgcaucugcuccaaggggaagcggaccgucgaccucggccagugcgggcugcugggcacgaucaccggcccgccccagugcgaucaguuccucgaguucagcgccgaccugaucaucgagcgccgggagggguccgacgugugcuaccccggcaaguucgugaaugaggaggcccugcgccagauccuccgggagagcgggggcaucgacaaggaggccaugggguucaccuacuccggcauccgcaccaacggcgcgacgagcgccugccggcgcuccgggaguuccuucuacgccgaaaugaaguggcugcugagcaacaccgacaacgccgcguucccgcccaugaccaaguccuauaagaacacccggaaggcccccgcccucaucaucuggggcauccaccacagcggguccacggccgagcagaccaagcuguacggcagcggcaacaagcuggucaccgugcgcuccagcaauuaccagcaguccuucgugcccagccccggggccggcccccaggucaacgggcagagcggccggaucgacuuccauuggcucaugcugaaccccaacgacaccgugacguucuccuucaacggggcguucaucgcccccgaucgcgccagcuuccugcggggcaaguccaugggcauccagagcggggugcaggucgacgccaacugcgagggcgacugcuaucacuccgggggcaccaucaucagcaaccucccguuccagaacaucgacucccgcgugguggggaagugcccccgguaugucaagcagaagucccugcugcucgccaccggcaugaaaaacgugcccgagauccccaagggccgcgggcuguucggcgcgaucgccggguucaucgagaacggcugggaggggcugaucgacggcugguacggcuuccggcaucagaacgcccagggggagggcaccgccgccgacuacaagagcacgcagagcgcgaucaaccagaugaccgggaagcucaaccgccugaucgagaagaccaaccagcaguuugagcugaucgacaacgaguucaccgagguggagaagcagaucggcaacgucaucaacuggacgcgggacuccaucaccgaaguguggagcuauaacgccgagcuccugguggccauggagaaccagcacaccaucgaccuggccgacuccgagaugaacaagcucuacgagcgcgucaagcgccagcugcgggagaaugccgaggaggacggcaccgggugcuucgagaucuuccacaagugcgacgacgauugcauggcgagcauccgcaacaacacguacgaccacuccaaguaucgggaggaggccaugcagaaccgcauccagaucgacccggugaagcugagcuccggcuacaaggacgucauccucugguucagcuuuggggccuccugcuucauccugcuggccaucgcgaugggccucguguucaucugcgugaagaacgggaacaugcggugcaccaucugcaucuga

SEQ ID NO: 10474 - RNA, 1683 nt, Artificial Sequence
  derived and/or modified CDS sequence (AUadapt) from InfluenzaA__AGQ81018__HA
augaauacccaaauccugguguucgcccucaucgccaucauccccaccaacagcgacaagaucugccugggccaccacgcggucuccaacgggacgaaggugaauacccugaccgagcgcggcguggaggucgugaacgccaccgagacgguggagcggaccagcaucccgcgcaucugcuccaaggggaagcggaccgucgaccucggccagugcgggcugcugggcaccaucacgggcccgccccagugcgaccaguuccucgaguuuagcgccgaccugaucaucgagcgccgggagggguccgacgugugcuaccccggcaaguucgugaacgaggaggcccugcgccagauccuccgggagagcgggggcaucgucaaggaggccaugggguuuaccuacuccggcauccgcaccaacggcgcgaccagcgccugccggcgcuccgggagcuccuucuacgccgaaaugaaguggcugcugagcaacacggauaacgccgcguucccgcccaugaccaaguccuacaagaacacccggaaggcccccgccaucaucaucuggggcauccaccacagcggguccaccgccgagcagacgaagcucuacggcaguggcaacaagcuggugaccgugcgcuccagcaacuaccagcaguccuucguccccagccccggggccggcccccaggugaacgggcagagcggccggaucgauuuccacuggcugaugcucaaccccaacgacaccgugaccuucuccuucaacggggcguucaucgcccccgaucgcgccagcuuccugcggggcaaguccaugggcauccagagcgggguccagguggacgccaacugcgagggcgacugcuaucacucccgcgggacgaucaucagcaaccugccguuccagaacaucgacucccggguggucggcaagugcccccgcuacgugaagcagaagucccuccugcuggccaccgggaugaaaaaugugcccgagauccccaagggccggggccucuucggggcgaucgccggcuucaucgagaacgggugggagggccugaucgacgggugguacggcuuccgccaccagaacgcccagggcgaggggaccgccgccgacuauaagagcacccagagcgcgaucaaccagaugacgggcaagcugaaccggcucaucgagaagaccaaccagcaguucgagcugaucgacaacgaguuuaccgaggucgagaagcagaucgggaacgugaucaacuggacccgcgacuccaucacggaaguguggagcuacaacgccgagcugcucgucgccauggagaaccagcacaccaucgaucuggccgacuccgagaugaacaagcuguacgagcgcgugaagcggcagcuccgcgagaacgccgaggaggacggcaccggcugcuucgagaucuuccacaagugugacgacgacugcauggcgagcauccggaacaacaccuacgaucacuccaaguaccgcgaggaggccaugcagaaccggauccagaucgacccggucaagcugagcuccggguacaaggacgugauccugugguucaguuucggcgccuccugcuucauccuccuggccaucgcgauggggcugguguucaucugcgucaagaacggcaacaugcgcugcacgaucugcaucuga

SEQ ID NO: 10475 - RNA, 1683 nt, Artificial Sequence; identical to SEQ ID NO: 10474
  derived and/or modified CDS sequence (AUadapt) from InfluenzaA__AGQ81019__HA

SEQ ID NO: 10476 - RNA, 1683 nt, Artificial Sequence; identical to SEQ ID NO: 10473
  derived and/or modified CDS sequence (AUadapt) from InfluenzaA__AGQ81020__HA

SEQ ID NO: 10477 - RNA, 1683 nt, Artificial Sequence; identical to SEQ ID NO: 10474
  derived and/or modified CDS sequence (AUadapt) from InfluenzaA__AGQ81021__HA

SEQ ID NO: 10478 - RNA, 1683 nt, Artificial Sequence; identical to SEQ ID NO: 10473
  derived and/or modified CDS sequence (AUadapt) from InfluenzaA__AGQ81022__HA

SEQ ID NO: 10479 - RNA, 1683 nt, Artificial Sequence; identical to SEQ ID NO: 10474
  derived and/or modified CDS sequence (AUadapt) from InfluenzaA__AGQ81023__HA

SEQ ID NO: 10480 - RNA, 1683 nt, Artificial Sequence
  derived and/or modified CDS sequence (AUadapt) from InfluenzaA__AGQ81025__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaucaguuccucgaguucuccgccgaccugaucaucgagcgccgggaggggagcgacgugugcuaccccggcaaguuugugaacgaggaagcccugcgccagauccuccgggaguccgggggcaucgacaaggaggcgaugggguucaccuacagcggcauccgcaccaacggcgucaccuccgccugccggcgcagcggguccaguuucuacgccgagaugaaguggcugcuguccaacacggacaacgccgcguucccgcccaugaccaagagcuauaagaacacccggaaggcccccgcccucaucaucuggggcauccaccacuccgggagcaccgccgagcagacgaagcuguacggcuccggcaacaagcuggugaccgugcgcagcuccaauuaccagcagagcuucguccccucccccggggccggcccccaggugaacgggcagagcggccggaucgacuuccauuggcucaugcugaaccccaacgacaccgugaccuucagcuucaacggggcguucaucgcccccgaucgcgccuccuuccugcggggcaaaagcaugggcauccaguccgggguccagguggacgccaacugcgagggcgacugcuaucacagcgggggcacgaucaucuccaaccucccguuccagaacaucgacagccgcguggucgggaaguguccccgguacgugaagcagaagucccugcugcucgccaccggcaugaagaacgugcccgagauccccaagggccgcgggcuguucggcgcgaucgccggguucaucgagaacggcugggaggggcugaucgacggcugguacggcuuccggcaucagaacgcccagggggagggcaccgccgccgacuacaaaagcacccaguccgcgaucaaccagaugacggggaagcucaaccgccugaucgagaagaccaaccagcaguuuggccugaucgacaacgaguucaccgaggucgagaagcagaucggcaacgugaucaacuggacccgggacagcaucacggaggugugguccuauaacgccgagcuccuggucgccauggagaaccagcacaccaucgaccuggccgacagcgagaugaacaaacucuaugagcgcgugaagcgccagcugcgggagaacgccgaggaggacgggaccggcugcuucgagaucuuccacaagugcgacgaugacugcauggcguccauccgcaacaacaccuacgaccacaguaaguaccgggaggaggccaugcagaaccgcauccagaucgacccggucaagcuguccagcggguacaaggacgugauccucugguucuccuuuggcgccagcugcuucauccugcuggccaucgcgauggggcucguggucaucugcgugaagaacggcaacaugcggugcacgaucugcaucuga

SEQ ID NO: 10481 - RNA, 1683 nt, Artificial Sequence
  derived and/or modified CDS sequence (AUadapt) from InfluenzaA__AGQ81026__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugugaccaguuccucgaguucuccgccgaccugaucaucgagcgccgggaggggagcgacgugugcuaucccggcaaguucgugaacgaggaggcccugcgccagauccuccgggaguccgggggcaucgacaaggaggcgaugggguucaccuacagcggcauccgcaccaacggcgccaccuccgccugucggcgcagcggguccagcuucuacgccgaaaugaaguggcugcuguccaacacggacaacgcggccuuuccgcccaccaccaagagcuacaagaacacccggaaggcccccgcccucaucaucuggggcauccaccacuccgggagcacggccgagcagaccaagcuguacggcuccggcaauaagcuggucaccgugcgcagcuccaacuaccagcagagcuucgugcccucccccggggcgggcccccaggucaacgggcagagcggccggaucgauuuccacuggcucaugcugaaccccaacgacaccgugacguucagcuuuaacggggccuucaucgcccccgaccgcgccuccuuccugcggggcaagagcaugggcauccaguccggggugcaggucgacgccaacugugagggcgacugcuaccacagcgggggcaccaucaucuccaaccucccguuucagaacaucgacagccgcgugguggggaagugcccccgguacgucaagcagaagucccugcugcucgcgaccggcaugaaaaacgugcccgagauccccaagggccgcgggcuguucggcgccaucgccggguuuaucgagaacggcugggaggggcugaucgacggcugguacggcuuccggcaccagaacgcccagggggagggcaccgccgcggacuauaagagcacgcaguccgccaucaaccagaugaccgggaagcucaaccgccugaucgagaagaccaaccagcaguucgagcugaucgacaacgaguuuaccgagguggagaagcagaucggcaacgucaucaacuggacgcgggacagcaucaccgaagugugguccuacaacgccgagcuccugguggccauggagaaccagcauaccaucgaccuggccgacagcgagaugaacaagcucuacgagcgcgucaagcgccagcugcgggagaacgcggaggaggacggcaccggguguuucgagaucuuccacaagugcgacgacgacuguauggccuccauccgcaacaacacguacgaccacagcaaguaccgggaggaggccaugcagaaucgcauccagaucgacccggugaagcuguccagcggcuacaaggacgucauccucugguucuccuucggggccagcuguuucauccugcuggcgaucgccaugggccucguguucaucugcgugaagaacgggaacaugcggugcaccaucugcaucuga

SEQ ID NO: 10482 - RNA, 1683 nt, Artificial Sequence
  derived and/or modified CDS sequence (AUadapt) from InfluenzaA__AGQ81027__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuucucgaguucuccgccgaccugaucaucgagcgccgggaggggagcgacgugugcuaccccggcaaguucgugaacgaggaggcccugcgccagauccuccgggaguccgggggcaucgauaaggaggcgaugggguucaccuacagcggcauccgcaccaacggcgucaccuccgccugccggcgcagcggguccagcuucuaugccgaaaugaaguggcugcuguccaacacggacaacgccgcguucccgcccaugaccaagagcuacaagaacacccggaaggcccccgcccucaucaucuggggcauccaccauuccgggagcaccgccgagcagacgaagcuguacggcuccggcaacaagcuggugaccgugcgcagcuccaacuaccagcagagcuuuguccccucccccggggccggcccccaggugaacgggcagagcggccggaucgacuuccacuggcucaugcugaaccccaacgacaccgugaccuuuagcuucaacggggcguucaucgcccccgaccgcgccuccuuccugcggggcaagagcaugggcauccaguccgggguccagguggacgccaauugcgagggcgacugcuaccacagcgggggcacgaucaucuccaaccucccguuccagaauaucgacagccgcguggucgggaagugcccccgguacgugaagcagaagucccugcugcucgccaccggcaugaaaaacgugcccgagauccccaagggccgcgggcuguucggcgcgaucgccggguucaucgagaacggcugggaggggcugaucgauggcugguacggcuuccggcaccagaacgcccagggggagggcaccgccgccgacuacaagagcacccaguccgcgaucaaccagaugacggggaagcucaaucgccugaucgagaagaccaaccagcaguucgagcugaucgacaacgaguucaccgaggucgagaagcagaucggcaacgugaucaacuggacccgggauagcaucacggaagugugguccuacaacgccgagcuccuggucgccauggagaaccagcacaccaucgaccuggccgacagcgagaugaauaagcucuacgagcgcgugaagcgccagcugcgggagaacgccgaggaggacggcaccgggugcuucgagaucuuccacaagugcgaugacgacugcauggcguccauccgcaacaacaccuacgaccacaguaaguaccgggaggaggccaugcagaaccgcauccagaucgacccggucaagcuguccagcggcuacaaggacgugauccucugguucuccuucggggccaguugcuucauccugcuggccaucgcgaugggccucguguucaucugcgucaagaacgggaacaugcggugcacgaucugcaucuga

SEQ ID NO: 10483 - RNA, 1683 nt, Artificial Sequence
  derived and/or modified CDS sequence (AUadapt) from InfluenzaA__AGQ81028__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugugaccaguuccucgaguucuccgccgaccugaucaucgagcgccgggaggggagcgacgugugcuaucccggcaaguucgugaacgaggaggcccugcgccagauccuccgggaguccgggggcaucgacaaggaggcgaugggguucaccuacagcggcauccgcaccaacggcgccaccuccgccugucggcgcagcggguccagcuucuacgccgagaugaaguggcugcuguccaacacggacaacgcggccuuuccgcccaccaccaagagcuacaagaacacccggaaggcccccgcccucaucaucuggggcauccaccacuccgggagcacggccgagcagaccaaacuguacggcuccggcaauaagcuggucaccgugcgcagcuccaacuaccagcagagcuucgugcccucccccggggcgggcccccaggucaacgggcagagcggccggaucgauuuccacuggcucaugcugaaccccaacgacaccgugacguucagcuuuaacggggccuucaucgcccccgaccgcgccuccuuccugcggggcaagagcaugggcauccaguccggggugcaggucgacgccaacugugagggcgacugcuaccacagcgggggcaccaucaucuccaaccucccguuucagaacaucgacagccgcgugguggggaagugcccccgguacgucaagcagaagucccugcugcucgcgaccggcaugaagaacgugcccgagauccccaagggccgcgggcuguucggcgccaucgccggguuuaucgagaacggcugggaggggcugaucgacggcugguacggcuuccggcaccagaacgcccagggggagggcaccgccgcggacuauaagagcacgcaguccgccaucaaccagaugaccgggaagcucaaccgccugaucgagaagaccaaccagcaauucgagcugaucgacaacgaguuuaccgagguggagaagcagaucggcaacgucaucaacuggacgcgggacagcaucaccgagaugugguccuacaacgccgagcuccugguggccauggagaaccagcauaccaucgaccuggccgacagcgagaugaacaagcucuacgagcgcgugaagcgccagcugcgggagaacgcggaggaggacggcaccggguguuucgagaucuuccacaagugcgacgacgacuguauggccuccauccgcaacaacacguacgaccacagcaaguaccgggaggaggccaugcagaaucgcauccagaucgacccggucaagcuguccagcggcuacaaggacgugauccucugguucuccuucggggccagcuguuucauccugcuggcgaucgccaugggccucgucuucaucugcgugaagaacgggaacaugcggugcaccaucugcaucuga

SEQ ID NO: 10484 - RNA, 1683 nt, Artificial Sequence
  derived and/or modified CDS sequence (AUadapt) from InfluenzaA__AGQ81029__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaccaguuucucgaguucuccgccgaccugaucaucgagcgccgggaggggagcgacgugugcuaccccggcaaguucgugaacgaggaggcccugcgccagauccuccgggaguccgggggcaucgauaaggaggcgaugggguucaccuacagcggcauccgcaccaacggcgucaccuccgccugccggcgcagcggguccagcuucuaugccgagaugaaguggcugcuguccaacacggacaacgccgcguucccgcccaugaccaagagcuacaagaacacccggaaggcccccgcccucaucaucuggggcauccaccauuccgggagcaccgccgagcagacgaaacuguacggcuccggcaacaagcuggugaccgugcgcagcuccaacuaccagcagagcuuuaugcccucccccggggccggcccccaggucaacgggcagagcggccggaucgacuuccacuggcucaugcugaaccccaacgacaccgugaccuuuagcuucaacggggcguucaucgcccccgaccgcgccuccuuccugcggggcaagagcaugggcauccaguccggggugcaggucgacgccaauugcgagggcgacugcuaccacagcgggggcacgaucaucuccaaccucccguuccagaauaucgacagccgcgugguggggaagugcccccgguacgucaagcagaagucccugcugcucgccaccggcaugaagaacgugcccgagauccccaagggccgcgggcuguucggcgcgaucgccggguucaucgagaacggcugggaggggcugaucgauggcugguacggcuuccggcaccagaacgcccagggggagggcaccgccgccgacuacaagagcacccaguccgcgaucaaccagaugacggggaagcucaaucgccugaucgagaagaccaaccagcaauucgagcugaucgacaacgaguucaccgagguggagaagcagaucggcaacgucaucaacuggacccgggauagcaucacggaggugugguccuacaacgccgagcuccugguggccauggagaaccagcacaccaucgaccuggccgacagcgagaugaauaagcucuacgagcgcgucaagcgccagcugcgggagaacgccgaggaggacggcaccgggugcuucgagaucuuccacaagugcgaugacgacugcauggcguccauccgcaacaacaccuacgaccacaguaaguaccgggaggaggccaugcagaaccgcauccagaucgacccggugaagcuguccagcggcuacaaggacgucauccucugguucuccuucggggccaguugcuucauccugcuggccaucgcgaugggccucguguucaucugcgugaagaacgggaacaugcggugcacgaucugcaucuga

SEQ ID NO: 10485 - RNA, 1683 nt, Artificial Sequence
  derived and/or modified CDS sequence (AUadapt) from InfluenzaA__AGQ81031__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaucaguuccucgaguucuccgccgaccugaucaucgagcgccgggaggggagcgacgugugcuaccccggcaaguucgugaaugaggaggcccugcgccagauccuccgggaguccgggggcaucaacaaggaggcgaugggguucaccuacagcggcauccgcaccaacggcgccaccuccgccugccggcgcagcggguccaguuucuacgccgaaaugaaguggcugcuguccaacacggacaacgcggccuucccgcccaugaccaagagcuauaagaacacccggaaggcccccgcccucaucaucuggggcauccaccacuccgggagcaccgccgagcagacgaagcuguacggcuccggcaacaagauggucaccgugcgcagcuccaacuaucagcagagcuucgugcccucccccggggcgggcccccaggucaacgggcagagcggccggaucgacuuccacuggcugaugcucaaucccaacgacaccgugaccuucagcuucaacggggccuucaucgcccccgaucgcgccuccuuccugcggggcaagagcaugggcauccaguccggggugcaggucgacgccaacugcgagggcgacugcuaccauagcgggggcacgaucaucuccaaccugccguuccagaacaucgacagccgcgugguggggaagugcccccgguaugucaagcagaagucccuccugcuggcgaccggcaugaaaaacgugcccgagauccccaagggccgcggccucuucggggccaucgccggguucaucgagaacggcugggaggggcugaucgacggcugguacggcuuccggcaucagaacgcccagggggagggcaccgccgcggacuacaagagcacccaguccgccaucaaccagaugacggggaagcugaaccgccucaucgagaagaccaaccagcaguucgagcugaucgauaacgaguucaccgagguggagcggcagaucggcaacgucaucaacuggacccgcgacagcaucacggaggugugguccuacaaugccgaacugcucguggccauggagaaccagcacaccaucgaccuggccgacagcgagaugaacaagcuguacgagcgcgucaagcggcagcuccgcgagaaugcggaggaggacggcaccgggugcuucgagaucuuccacaagugcgacgacgauugcauggccuccauccggaacaacaccuacgaccacagcaaguaucgcgaggaggccaugcagaaccggauccagaucgacccggugaagcuguccagcggcuacaaggacgucauccugugguucuccuucggggccaguugcuucauccuccuggcgaucgccaugggccugguguucaucugcgugaagaacgggaacaugcgcugcacgaucugcaucuga

SEQ ID NO: 10486 - RNA, 1683 nt, Artificial Sequence; identical to SEQ ID NO: 10481
  derived and/or modified CDS sequence (AUadapt) from InfluenzaA__AGQ81032__HA

SEQ ID NO: 10487 - RNA, 1683 nt, Artificial Sequence; identical to SEQ ID NO: 10482
  derived and/or modified CDS sequence (AUadapt) from InfluenzaA__AGQ81033__HA

SEQ ID NO: 10488 - RNA, 1683 nt, Artificial Sequence; identical to SEQ ID NO: 10481
  derived and/or modified CDS sequence (AUadapt) from InfluenzaA__AGQ81034__HA

SEQ ID NO: 10489 - RNA, 1683 nt, Artificial Sequence; identical to SEQ ID NO: 10482
  derived and/or modified CDS sequence (AUadapt) from InfluenzaA__AGQ81035__HA

SEQ ID NO: 10490 - RNA, 1683 nt, Artificial Sequence; identical to SEQ ID NO: 10482
  derived and/or modified CDS sequence (AUadapt) from InfluenzaA__AGQ81036__HA

SEQ ID NO: 10491 - RNA, 1683 nt, Artificial Sequence; identical to SEQ ID NO: 10482
  derived and/or modified CDS sequence (AUadapt) from InfluenzaA__AGQ81037__HA

SEQ ID NO: 10492 - RNA, 1683 nt, Artificial Sequence; identical to SEQ ID NO: 10474
  derived and/or modified CDS sequence (AUadapt) from InfluenzaA__AGQ81038__HA

SEQ ID NO: 10493 - RNA, 1683 nt, Artificial Sequence; identical to SEQ ID NO: 10474
  derived and/or modified CDS sequence (AUadapt) from InfluenzaA__AGQ81039__HA

SEQ ID NO: 10494 - RNA, 1683 nt, Artificial Sequence
  derived and/or modified CDS sequence (AUadapt) from InfluenzaA__AGQ81040__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugugaccaguuccucgaguucagcgccgaccugaucaucgagcgccgggagggguccgacgugugcuaucccggcaaguucgugaacgaggaggcccugcgccagauccuccgggagagcgggggcaucgacaaggaggcgaugggguucaccuacuccggcauccgcaccaacggcgccaccagugccugccggcgcuccgggagcuccuucuacgccgagaugaaguggcugcugagcaacacggacaaugcggccuucccccagaugaccaaguccuacaagaacacccggaaggaccccgcccucaucaucuggggcauccaccacagcggguccaccgccgagcagacgaagcuguauggcagcggcaacaagcuggucaccgugggguccagcaacuaccagcaguccuucgugcccagccccggcgcccgcccgcaggucaaugggcaguccggccggaucgacuuccacuggcucaugcugaaccccaacgacaccgugaccuucaguuucaacggggcguucaucgcccccgaccgcgccagcuuccugcggggcaaguccaugggcauccagagcggggugcagaucgaugccaacugcgagggcgacugcuaccacuccgggggcacgaucaucagcaaucuccccuuccagaacaucgacucccgcgccgucgggaagugcccgcgguacgugaagcagaagucccugcugcucgcgaccggcaugaagaacgugcccgagauccccaagggccgcgggcuguucggcgccaucgccggguuuaucgagaacggcugggaggggcugaucgacggcugguacggcuuccggcaccagaacgcccagggggagggcaccgccgcggacuauaagagcacccagagcgccaucgaccagaucacggggaagcucaaccgccugaucgagaagaccaaccagcaguucgagcugaucgacaaugaguucaccgaggucgagaagcagaucggcaacgugaucaacuggacccgggacuccaucacggagguguggagcuacaacgccgagcuccuggucgccauggagaaucagcacaccaucgaccuggccgacuccgagaugaacaagcucuacgagcgcgugaagcgccagcugcgggagaacgcggaggaggacggcaccggguguuucgagaucuuccacaagugcgacgacgacuguauggccagcauccgcaacaacaccuacgaccacuccaaguaccgggaggaggccaugcagaaucgcauccagaucgaccccgugaagcugagcuccggcuacaaggacgucauccucugguucagcuucggggccuccuguuucauccugcuggcgaucgccaugggccucguguucaucugcgucaagaacgggaacaugcggugcacgaucugcaucuga

SEQ ID NO: 10495 - RNA, 1683 nt, Artificial Sequence
  derived and/or modified CDS sequence (AUadapt) from InfluenzaA__AGQ81041__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugugaccaguuccucgaguucagcgccgaccugaucaucgagcgccgggagggguccgacguguguuaccccggcaaguucgugaacgaggaggcccugcgccagauccuccgggagagcgggggcaucgacaaggaggcgaugggguucaccuacuccggcauccgcaccaauggcgccaccagcgccugccggcgcuccgggagcuccuucuacgccgagaugaaguggcugcugagcaauacggacaacgcggccuucccccagaccaccaaguccuacaagaacacccggaaggaccccgcccucaucaucuggggcauccaccauagcggguccacggccgagcagaccaagcuguacggcagcggcaacaagcuggucaccgugggguccagcaacuaucagcaguccuucgugcccagccccggcgcccgcccgcaggucaacgggcaguccggccggaucgacuuccacuggcucaugcugaaccccaaugacaccgugacguucagcuucaacggggcguucaucgcccccgaucgcgccagcuuccugcggggcaaguccaugggcauccagagcggggugcaggucgacgccaacugcgagggcgacuguuaccacuccgggggcaccaucaucagcaaccuccccuuccagaacaucgacucccgcgccguggggaaguguccgcgguacgugaagcagaagucccugcugcucgcgaccggcaugaaaaacguccccgagauccccaagggccgcgggcuguucggcgccaucgccggguucaucgagaacggcugggaggggcugaucgacggcugguauggcuuccggcaccagaacgcccagggggagggcaccgccgcggacuacaagagcacgcagagcgccaucgaucagaucaccgggaagcucaaccgccugaucgagaagaccaaccagcaguucgagcugaucgacaacgaguucaccgagguggagaagcagaucggcaaugugaucaacuggacgcgggacuccaucaccgaggucuggagcuacaacgccgagcuccugguggccauggagaaccagcacaccaucgaucuggccgacuccgagaugaacaagcucuacgagcgcgugaagcgccagcugcgggagaacgcggaggaggacggcaccgggugcuuugagaucuuccacaagugcgacgacgacugcauggccaguauccgcaacaacacguacgaccacuccaaguaccgggaggaggccaugcagaaucgcauccagaucgaccccgucaagcugagcuccggcuacaaggacgugauccucugguucagcuucggggccuccuguuucauccugcuggcgaucgccaugggccucgucuucaucugcgugaagaacgggaacaugcggugcaccaucugcaucuga

SEQ ID NO: 10496 - RNA, 1683 nt, Artificial Sequence
  derived and/or modified CDS sequence (AUadapt) from InfluenzaA__AGQ81042__HA
augaauacccaaauccugguguucgcccucaucgccaucauccccaccaacgcggacaagaucugccugggccaccacgccgucaguaacgggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugugaccaguuccucgaguucagcgccgaccugaucaucgagcgccgggagggguccgacgugugcuaucccggcaaguucgugaacgaggaggcccugcgccagauccuccgggagagcgggggcaucgacaaggaggcgaugggguucaccuacuccggcauccgcaccaacggcgccaccagugccugccggcgcuccgggagcuccuucuacgccgagaugaaguggcugcugagcaacacggacaaugcggccuucccccagaugaccaaguccuacaagaacacccggaaggaccccgcccucaucaucuggggcauccaccacagcggguccaccgccgagcagacgaagcuguauggcagcggcaacaagcuggucaccgugggguccagcaacuaccagcaguccuucgugcccagccccggcgcccgcccgcaggucaaugggcaguccggccggaucgacuuccacuggcucaugcugaaccccaacgacaccgugaccuucaguuucaacggggcguucaucgcccccgaccgcgccagcuuccugcggggcaaguccaugggcauccagagcggggugcaggucgaugccaacugcgagggcgacugcuaccacuccgggggcacgaucaucagcaaucuccccuuccagaacaucgacucccgcgccguggggaagugcccgcgguacgugaagcagaagucccugcugcucgcgaccggcaugaaaaacguccccgagauccccaagggccgcgggcuguucggcgccaucgccggguuuaucgagaacggcugggaggggcugaucgacggcugguacggcuuccggcaccagaacgcccagggggagggcaccgccgcggacuauaagagcacccagagcgccaucgaccagaucacggggaagcucaaccgccugaucgagaagaccaaccagcaguucgagcugaucgacaaugaguucaccgagguggagaagcagaucggcaacgugaucaacuggacccgggacuccaucacggaggucuggagcuacaacgccgagcuccugguggccauggagaaucagcacaccaucgaccuggccgacuccgagaugaacaagcucuacgagcgcgugaagcgccagcugcgggagaacgcggaggaggacggcaccggguguuucgagaucuuccacaagugcgacgacgacuguauggccagcauccgcaacaacaccuacgaccacuccaaguaccgggaggaggccaugcagaaucgcauccagaucgaccccgucaagcugagcuccggcuacaaggacgugauccucugguucagcuucggggccuccuguuucauccugcuggcgaucgccaugggccucgucuucaucugcgugaagaacgggaacaugcggugcacgaucugcaucuga

SEQ ID NO: 10497 - RNA, 1683 nt, Artificial Sequence
  derived and/or modified CDS sequence (AUadapt) from InfluenzaA__AGQ81043__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggagggguccgacgugugcuaccccggcaaguucgugaacgaggaagcccugcgccagauccuccgggagagcgggggcaucgacaaggaggagaugggguuuaccuacuccggcauccgcaccaacggcgcgaccagcgccugccggcgcuccgggagcuccuucuacgccgagaugaaguggcugcugagcaacacggauaacgccgcguucccgcagaugaccaaguccuacaagaacacccgcaagagccccgcccucaucgucuggggcauccaccacuccgugagcaccgccgagcagacgaagcuguauggguccggcaacaagcuggugaccgucggcagcuccaacuaccagcagagcuucgugcccucccccggggcccggccccaagugaacggccucagcgggcggaucgacuuucacuggcugaugcugaaccccaacgacaccgucaccuucagcuucaacggcgccuuuaucgcgcccgaccgcgccuccuuccuccggggcaagagcauggggauccaguccggcguccagguggacgccaacugcgagggggacugcuaccauagcggcgggacgaucaucuccaaccugcccuuccagaacaucgacagccgcgccgugggcaagugcccgcgguacgugaagcagcgcucccugcuccuggccaccgggaugaagaaugugcccgagauccccaagggccggggccuguucggggcgaucgccggcuucaucgagaacgggugggagggccucaucgacgggugguacggcuuccgccaccagaacgcccagggcgaggggaccgccgccgacuauaagagcacccaauccgcgaucgaccagaucacgggcaagcugaaccggcugaucgagaagaccaaccagcaguucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaaacuguacgagcgcgugaagcggcagcugcgcgagaacgccgaggaggacggcaccggcugcuucgagaucuuccauaagugcgacgacgacugcauggcguccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgccaucgugauggggcuggucuucaucugcgugaagaacggcaacaugcgcugcaccaucugcaucuga

SEQ ID NO: 10498 - RNA, 1683 nt, Artificial Sequence; identical to SEQ ID NO: 86
  derived and/or modified CDS sequence (AUadapt) from InfluenzaA__AGQ81044__HA

SEQ ID NO: 10499 - RNA, 1683 nt, Artificial Sequence; identical to SEQ ID NO: 86
  derived and/or modified CDS sequence (AUadapt) from InfluenzaA__AGQ81045__HA

SEQ ID NO: 10500 - RNA, 1683 nt, Artificial Sequence; identical to SEQ ID NO: 86
  derived and/or modified CDS sequence (AUadapt) from InfluenzaA__AGQ81046__HA

SEQ ID NO: 10501 - RNA, 1683 nt, Artificial Sequence; identical to SEQ ID NO: 10482
  derived and/or modified CDS sequence (AUadapt) from InfluenzaA__AGQ81047__HA

SEQ ID NO: 10502 - RNA, 1683 nt, Artificial Sequence; identical to SEQ ID NO: 10481
  derived and/or modified CDS sequence (AUadapt) from InfluenzaA__AGQ81049__HA

SEQ ID NO: 10503 - RNA, 1683 nt, Artificial Sequence; identical to SEQ ID NO: 10482
  derived and/or modified CDS sequence (AUadapt) from InfluenzaA__AGQ81050__HA

SEQ ID NO: 10504 - RNA, 1683 nt, Artificial Sequence
  derived and/or modified CDS sequence (AUadapt) from InfluenzaA__AGQ81051__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaucaguuccucgaguucuccgccgaccugaucaucgagcgccgggaggggagcgacgugugcuaccccggcaaguucgugaaugaggaggcccugcgccagauccuccgggaguccgggggcaucaacaaggaggcgaugggguucaccuacagcggcauccgcaccaacggcgccaccuccgccugccggcgcagcggguccaguuucuacgccgagaugaaguggcugcuguccaacacggacaacgcggccuucccgcccaugaccaagagcuauaagaacacccggaaggcccccgcccucaucaucuggggcauccaccacuccgggagcaccgccgagcagacgaaacuguacggcuccggcaacaagcuggucaccgugcgcagcuccaacuaucagcagagcuucgugcccucccccggggcgggcccccaggucaacgggcagagcggccggaucgacuuccacuggcucaugcugaaucccaacgacaccgugaccuucagcuucaacggggccuucaucgcccccgaucgcgccuccuuccugcggggcaagagcaugggcauccaguccggggugcaggucgacgccaacugcgagggcgacugcuaccauagcgggggcacgaucaucuccaaccucccguuccagaacaucgacagccgcgugguggggaagugcccccgguaugucaagcagaagucccugcugcucgcgaccggcaugaagaacgugcccgagauccccaagggccgcgggcuguucggcgccaucgccggguucaucgagaacggcugggaggggcugaucgacggcugguacggcuuccggcaucagaacgcccagggggagggcaccgccgcggacuacaagagcacccaguccgccaucaaccagaugacggggaagcucaaccgccugaucgagaagaccaaccagcaauucgagcugaucgauaacgaguucaccgagguggagaagcagaucggcaacgucaucaacuggacccgggacagcaucacggaggugugguccuacaaugccgagcuccugguggccauggagaaccagcacaccaucgaccuggccgacagcgagaugaacaagcucuacgagcgcgucaagcgccagcugcgggagaaugcggaggaggacggcaccgggugcuucgagaucuuccacaagugcgacgacgauugcauggccuccauccgcaacaacaccuacgaccacagcaaguaucgggaggaggccaugcagaaccgcauccagaucgacccggugaagcuguccagcggcuacaaggacgucauccucugguucuccuucggggccaguugcuucauccugcuggcgaucgccaugggccucguguucaucugcgugaagaacgggaacaugcggugcacgaucugcaucuga

SEQ ID NO: 10505 - RNA, 1683 nt, Artificial Sequence; identical to SEQ ID NO: 10482
  derived and/or modified CDS sequence (AUadapt) from InfluenzaA__AGQ81052__HA

SEQ ID NO: 10506 - RNA, 1683 nt, Artificial Sequence
  derived and/or modified CDS sequence (AUadapt) from InfluenzaA__AGQ81053__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaucaguuccucgaguucuccgccgaccugaucaucgagcgccgggaggggagcgacgugugcuaccccggcaaguucgugaaugaggaggcccugcgccagauccuccgggaguccgggggcaucaacaaggaggcgaugggguucaccuacagcggcauccgcaccaacggcgccaccuccgccugccggcgcagcggguccaguuucuacgccgagaugaaguggcugcuguccaacacggacaacgcggccuucccgcccaugaccaagagcuauaagaacacccggaaggcccccgcccucaucaucuggggcauccaccacuccgggagcaccgccgagcagacgaagcuguacggcuccggcaacaagauggucaccgugcgcagcuccaacuaucagcagagcuucgugcccucccccggggcgggcccccaggucaacgggcagagcggccggaucgacuuccacuggcugaugcucaaucccaacgacaccgugaccuucagcuucaacggggccuucaucgcccccgaucgcgccuccuuccugcggggcaagagcaugggcauccaguccggggugcaggucgacgccaacugcgagggcgacugcuaccauagcgggggcacgaucaucuccaaccugccguuccagaacaucgacagccgcgugguggggaagugcccccgguaugucaagcagaagucccuccugcuggcgaccggcaugaagaacgugcccgagauccccaagggccgcggccucuucggggccaucgccggguucaucgagaacggcugggaggggcugaucgacggcugguacggcuuccggcaucagaacgcccagggggagggcaccgccgcggacuacaagagcacccaguccgccaucaaccagaugacggggaagcugaaccgccucaucgagaagaccaaccagcaguucgagcugaucgauaacgaguucaccgagguggagaagcagaucggcaacgucaucaacuggacccgggacagcaucacggaggugugguccuacaaugccgagcugcucguggccauggagaaccagcacaccaucgaccuggccgacagcgagaugaacaagcuguacgagcgcgucaagcgccagcuccgggagaaugcggaggaggacggcaccgggugcuucgagaucuuccacaagugcgacgacgauugcauggccuccauccgcaacaacaccuacgaccacagcaaguaucggaaggaggccaugcagaaccgcauccagaucgacccggugaagcuguccagcggcuacaaggacgucauccugugguucuccuucggggccaguugcuucauccuccuggcgaucgccaugggccugguguucaucugcgugaagaacgggaacaugcggugcacgaucugcaucuga

SEQ ID NO: 10507 - RNA, 1683 nt, Artificial Sequence; identical to SEQ ID NO: 10482
  derived and/or modified CDS sequence (AUadapt) from InfluenzaA__AGQ81055__HA

SEQ ID NO: 10508 - RNA, 1683 nt, Artificial Sequence; identical to SEQ ID NO: 10482
  derived and/or modified CDS sequence (AUadapt) from InfluenzaA__AGQ81056__HA

SEQ ID NO: 10509 - RNA, 1683 nt, Artificial Sequence; identical to SEQ ID NO: 10482
  derived and/or modified CDS sequence (AUadapt) from InfluenzaA__AGQ81057__HA

SEQ ID NO: 10510 - RNA, 1683 nt, Artificial Sequence; identical to SEQ ID NO: 10482
  derived and/or modified CDS sequence (AUadapt) from InfluenzaA__AGQ81058__HA

SEQ ID NO: 10511 - RNA, 1683 nt, Artificial Sequence; identical to SEQ ID NO: 86
  derived and/or modified CDS sequence (AUadapt) from InfluenzaA__AGQ81059__HA

SEQ ID NO: 10512 - RNA, 1683 nt, Artificial Sequence; identical to SEQ ID NO: 86
  derived and/or modified CDS sequence (AUadapt) from InfluenzaA__AGQ81060__HA

SEQ ID NO: 10513 - RNA, 1683 nt, Artificial Sequence; identical to SEQ ID NO: 86
  derived and/or modified CDS sequence (AUadapt) from InfluenzaA__AGQ81061__HA

SEQ ID NO: 10514 - RNA, 1683 nt, Artificial Sequence
  derived and/or modified CDS sequence (AUadapt) from InfluenzaA__AGQ81081__HA
auggagguggucagucugaucaccauccuccuggugaucaccggcuccaacgccgacaagaucugcaucggguaccagucgacgaacuccaccgagaccguggacacccugacggagaacaacguccccgugacccacgccaaggagcuccugcacaccgagcacaacggcaugcugugcgcgaccaaucucgggcgcccgcugauccuggacacgugcaccaucgagggccucaucuacgggaaccccagcugcgacauccugcugggcggccgggagugguccuacaucguggagcgccccucggccgucaacgggcucugcuaccccggcaacguggagaaccuggaggagcugcggucccucuucaguuccgccucguccuaccagcgcauccagaucuucccggacaccaucuggaacgugagcuacuccgggaccucgaaggccugcuccgacagcuucuaccgguccaugcgcuggcugacgcagaagaacaacgccuaucccguccaggacgcgcaguacaccaacaaccggggccgcaacauccuguucaugugggggaucaaccacccgcccaccgacaccgcccagacgaaccucuacacccggaccgacaccacgaccucgguggccaccgaggacaucaaccgcaccuuuaagccccugaucggcccccggccccuggugaacggccuccaggggcgcaucgacuacuacugggccguccugcggcccggccagacgcugcgcauccgguccaacgggaaccucaucgcgccgugguacggccacauccugagcggcgagucgcacgggcgcauccugaagaccgaccucaacuccggcaacugcguggugcagugucagaccgagcgcgggggccugaacaccacgcugcccuuccacaacgucagcaaguacgccuucgggaacugccccaaguacgugggcgugaagucccucaagcuggccgucggccugcggaacgugcccgcccggucgucccgcggccucuucggggccaucgcgggguucaucgagggcggguggaguggccugguggccggcugguacggguuccagcacuccaacgaccagggcaccgggauggccgccgaccgggacucgacccagaaggccaucgacaagaucaccuccaaggucaacaacaucguggacaagaugaacaagcaguacgagaucaucgaccaugaguucagcgagaucgagacgcgccugaacaugaucaacaacaagaucgacgaccagauccaggacaucugggcguacaacgccgagcuccuggugcugcucgagaaccagaagacccuggacgagcacgacgccaacgucaauaaccuguacaacaaggugaagcgcgcccucggcuccaacgccgucgaggacgggaagggcugcuucgagcuguaccacaagugcgacaaccagugcauggagaccauccggaacggcaccuacaaucgccggaaguacaaggaggagucgcgccuggagcggcagaagaucgagggggugaagcucgaguccgagggcacguacaagauccugaccaucuacagcaccguggcguccucgcuggucaucgccaugggguucgccgccuuccucuucugggccauguccaacggcagcugccgcugcaacaucugcaucuga

SEQ ID NO: 10515 - RNA, 1683 nt, Artificial Sequence
  derived and/or modified CDS sequence (AUadapt) from InfluenzaA__AGQ81086__HA
auggagguggucagucugaucaccauccuccuggugaucaccggcuccaacgccgacaagaucugcaucggguaccagagcacgaacuccaccgagaccguggacacccugacggagaacaacguccccgugacccacgccaaggagcuccugcacaccgagcacaacggcaugcugugugcgaccaaccucgggcgcccgcugauccuggacacgugcaccaucgagggccucaucuacgggaaccccucgugcgaccugcugcucggcggccgggagugguccuacaucguggagcgccccagcgccgucaacgggcugugcuaccccggcaauguggagaaccuggaggagcuccggucccuguucucguccgccagcuccuaccagcgcauccagaucuucccggacaccaucuggaacgugucguacuccgggaccagcaaggccugcuccgacucguuuuaccgguccaugcgcuggcugacgcagaagaacaacgccuaccccguccaggacgcgcaguacaccaacaaccggggccgcaacauccucuucaugugggggaucaaccacccgcccaccgacaccgcccagacgaaucuguacacccggaccgacaccacgaccagcguggccaccgaggacaucaaccgcaccuucaagccccugaucggcccccggccccucgugaacggccugcaggggcgcaucgacuacuacugggccguccugcggcccggccagacgcuccgcauccgguccaacgggaaccugaucgcgccgugguacggccauauccugucgggcgagagccacgggcgcauccucaagaccgaccugaacuccggcaacugcguggugcagugccagaccgagcgcgggggccugaacaccacgcuccccuuccacaacgucucgaaguacgccuuugggaacugccccaaguacgugggcgugaagucccugaagcuggccgucggccuccggaacgugcccgcccggagcucccgcgggcuguucggcgccaucgcgggguucaucgagggcggguggucgggccugguggccggcugguacggguuccagcacuccaacgaccagggcaccgggauggccgccgaucgggacagcacccagaaggccaucgacaagaucaccuccaaggucaacaacaucguggacaagaugaacaagcaguacgagaucaucgaccacgaguucucggagaucgagacgcgccucaacaugaucaauaacaagaucgacgaccagauccaggacaucugggcguacaacgccgagcugcuggugcuccuggagaaccagaagacccuggacgagcacgacgccaacgucaacaaccucuacaauaaggugaagcgcgcccugggcuccaacgccgucgaggacgggaagggcugcuucgagcuguaccacaagugcgacaaccagugcauggagaccauccggaacggcaccuacaaccgccggaaguauaaggaggagagccgccucgagcggcagaagaucgagggggugaagcuggaguccgagggcacguacaagauccugaccaucuacucgaccguggcguccagccucgucaucgccaugggguucgccgccuuccuguucugggccauguccaacggcagcugccgcugcaacaucugcaucuga

SEQ ID NO: 10516 - RNA, 1683 nt, Artificial Sequence
  derived and/or modified CDS sequence (AUadapt) from InfluenzaA__AGQ81087__HA
auggagaccgugagucugaucaccaugcuccuggucgccacggugaucaacgccgacaagaucugcaucggcuaccaguccaccaacucgaccgagaccguggacacgcugaccgagaacaacguccccgugacccacgcgaaggagcuccugcacaccgagcacaacgggaugcugugcgccacgaaccucggccacccgcugauccuggacacgugcaccaucgaggggcucaucuacggcaaccccuccugcgaccugcugcucgggggccgcgaguggucguacaucguggagcggcccuccgccgucaacggccugugcuaccccgggaacguggagaaccuggaggagcuccgcucgcuguucuccagcgccuccucguaccagcggauccagaucuucccggacaccaucuggaacguguccuacucgggcaccuccaaggccugcucggacuccuucuaccgcagcaugcgguggcugacccagaagaacaacgcguaccccauccaggacgcccaguacaccaacaaucgcgagaagaacauccucuucaugugggggaucaaccacccgcccaccgacacggcccagaccaaccuguacacccggaccgacacgaccaccuccgucgccaccgaggagaucaaccgcacguucaagccccugaucggcccccggccccucgugaacgggcugcagggccgcaucgacuacuacuggucggugcugaagcccggccagacccuccggauccgcuccaacgggaaccugaucgcgccgugguacggccacauccugucgggggagucgcacggccggguccucaagaccgaccugaagcgcggcuccugcaccgugcagugccagacggagaagggcgggcugaacaccacccuccccuuccagaacgugucgaaguacgccuucgggaacugcuccaaguacgucggcgucaagagccugaagcuggccguggggcuccggaacgugcccucccgcucgucccggggccuguucggcgccaucgccggguucaucgagggcggguggucgggccugguggcggggugguacggcuuccagcacuccaacgaccagggcguggggauggccgccgaccgcgacucgacccagaaggccaucgacaagaugacguccaaggucaacaacaucguggauaagaugaacaagcaguacgagaucaucaaccacgaguucagcgagaucgagacccggcucaacaugaucaacaacaagaucgacgaccagauccaggacaucugggccuacaacgcggagcugcuggugcuccuggagaaccagaagacccuggacgagcacgacgccaacgucaacaaccucuacaacaaggugaagcgcgcccugggcuccaacgccgucgaggacgggaagggcugcuucgagcuguaccacaagugcgacgaccagugcauggagaccauccggaacgggacguacaaccgccgccgguaccaggaggagucgaagcucgagcgccagaagaucgagggcgugaagcuggaguccgagggcaccuacaagauccugaccaucuacucgaccguggccuccucgcucgucaucgcgaugggguucgccgccuuccuguucugggccauguccaacggcagcugccggugcaacaucugcaucuga

SEQ ID NO: 10517 - RNA, 1683 nt, Artificial Sequence
  derived and/or modified CDS sequence (AUadapt) from InfluenzaA__AGQ81092__HA
auggagguggucagucugaucaccauccuccuggugaucaccggcuccaacgccgacaagaucugcaucggguaccagucgacgaacuccaccgagaccguggacacccugacggagaacaacguccccgugacccacgccaaggagcuccugcacaccgagcacaacggcaugcugugcgcgaccaaucucgggcgcccgcugauccuggacacgugcaccaucgagggccucaucuacgggaaccccagcugcgaccugcugcucggcggccgggagugguccuacaucguggagcgccccucggccgucaacgggcugugcuaccccggcaacguggagaaccuggaggagcuccggucccuguucaguuccgccucguccuaccagcgcauccagaucuucccggacaccaucuggaacgugagcuacaccgggacguccaaggccugcucggacuccuucuaccggagcaugcgcuggcugacccagaagaacaaugccuaccccguccaggacgcgcaguacaccaacaaccggggccgcaacauccucuucaugugggggaucaaccacccgcccaccgacacgacccagaccaaccuguacacccggacggacaccaccaccuccguggccacggaggacaucaaccgcaccuuuaagccccugaucggcccccggccccucgugaacggccugcaggggcgcaucgacuacuacugggccguccugcggcccggccagacccuccgcauccggucgaacgggaaccugaucgccccgugguacggccacauccuguccggcgagucgcacgggcgcauccucaagaccgaccucaagagcggcaacugcguggugcagugucagacggagcgcgggggccugaacaccacccugcccuuccacaacgucuccaaguacgcguucgggaacugccccaaguacgugggcgucaagucgcugaagcuggccgugggccuccggaacgugcccgcccgguccagccgcgggcuguucggcgccaucgccggguucaucgagggcgggugguccggccugguggcgggcugguauggguuccagcacucgaacgaccagggcaccgggauggccgccgaccgggacuccacgcagaaggccaucgacaagaucaccagcaaggucaacaacaucguggacaagaugaacaagcaguacgagaucaucgaccaugaguucuccgagaucgagacccgccucaacaugaucaacaacaagaucgacgaccagauccaggacaucugggccuacaacgcggagcugcuggugcuccuggagaaccagaagacccuggacgagcacgacgccaacgucaauaaccucuacaacaaggugaagcgcgcccugggcucgaacgccgucgaggacgggaagggcugcuucgagcuguaccacaagugcgacaaccagugcauggagacgauccggaacggcaccuauaaccgccggaaguacaaggaggagucccgccucgagcggcagaagaucgagggggugaagcuggagagcgagggcaccuacaagauccugaccaucuacuccaccguggccucgucccucgucaucgcgaugggguucgccgccuuccuguucugggccaugagcaacggcuccugccgcugcaacaucugcaucuga

SEQ ID NO: 10518 - RNA, 1683 nt, Artificial Sequence
  derived and/or modified CDS sequence (AUadapt) from InfluenzaA__AGQ81095__HA
auggagguggucagucugaucaccauccuccuggugaucaccguguccaacgccgacaagaucugcaucggcuaccagagcacgaacuccaccgagaccgucaacacccugacggaggacaacgugcccgugacccacgccaaggagcuccugcacaccgagcacaacgggaugcugugcgcgaccaaucucggccgcccgcugauccuggacacgugcaccaucgaggggcucaucuacggcaaccccucgugcgaccugcugcucgggggccgggagugguccuacaucgucgagcgccccagcgccgugaacggccugugcuaccccgggaacguggagaaccuggaggagcuccggucccuguucaguuccgccagcuccuaccagcgcauccagaucuucccggacaccaucuggaacgucucguacuccggcaccagcaaggccugcuccgacucguucuaccgguccaugcgcuggcugacgcagaagaacaacgccuaucccgugcaggacgcgcaguacaccaacaaccgggggcgcaacauccucuucauguggggcaucaaccacccgcccaccgacaccgcccagacgaaccuguacacccggaccgacaccacgaccagcguggccaccgaggacaucaaucgcaccuucaagccccugaucgggccccggccccucgucaacggccugcagggccgcaucgacuacuacugggccgugcugaagcccgggcagacgcuccggauccgcuccaacggcaaccugaucgcgccgugguacgggcacauccugucgggcgagagccacggccggauccucaagaccgaccugaacuccgggaacugugugguccagugccagucggagcgcggcgggcugaacaccacccuccccuuccacaacguguccaaguacgccuucggcaacugccccaaguacgugggggucaagagccugaagcuggccgugggccuccggaacgugcccgcccgcuccucgcggggccuguucggggccaucgcgggcuuuaucgagggcgggugguccgggcuggucgccggcugguacggcuuccagcacagcaacgaccaggggacgggcauggccgccgaccgcgacuccacccagaaggccaucgacaagaucaccucgaaggugaacaacaucguggacaagaugaacaagcaguaugagaucaucgaccacgaguucuccgagaucgagacccggcucaacaugaucaacaacaagaucgacgaccagauccaggacaucugggcguacaacgccgagcugcugguccuccuggagaaccagaagacgcuggacgagcacgacgccaaugugaacaaccucuacaacaaggucaagcgcgcccuggggagcaacgccguggaggacggcaaggggugcuucgagcuguaccacaagugcgacaaccagugcauggagaccauccgcaauggcaccuacgaccggcgcaaguacaaggaggagucccggcucgagcgccagaagaucgagggcgugaagcuggagucggaggggaccuacaagauccugacgaucuacuccaccgucgcgagcucccucgugaucgccaugggcuucgccgccuuccuguucugggccaugagcaacggguccugccggcgcaacaucugcaucuga

SEQ ID NO: 10519 - RNA, 1683 nt, Artificial Sequence
  derived and/or modified CDS sequence (AUadapt) from InfluenzaA__AGQ81099__HA
auggagaccgugagucugaucaccauccuccugaucgucacgguguccaacgccgacaagaucugcaucggcuaccagucgaccaacuccaccgagaccguggacacgcugaccgagaacaacguccccgugacccacgccaaggagcuccugcacaccgagcacaacgggaugcugugcgcgacgaaccucggccacccgcugauccuggacacgugcaccaucgaggggcucaucuacggcaaccccucgugcgaccugcugcucgggggccgcgagugguccuacaucguggagcggcccucggccgucaacggccugugcuaccccgggaacguggagaaccuggaggagcuccgcucccuguucucguccgccaacucguaccagcggauccagaucuucccggacaccaucuggaacguguccuacucgggcaccuccaaggccugcagcgacuccuucuaccgcucgaugcgguggcugacccagaagaacaacgccuaccccacccaggacgcgcaguacaccaauaaccgcgagaagaacauccucuucaugugggggaucaaccacccgcccacggacaccgcccagaccaaccuguacacccggacggacaccaccaccuccgucgccacggaggagaucaaccgcaccuucaagccccugaucggcccccggccccucgugaacgggcugcagggccgcaucgacuacuacuggucggugcugaagcccggccagacccuccggauccgcuccaacgggaaccugaucgccccgugguacggccacauccugucgggggagucgcacggccggauccucaagaccgaccugaagcgcggcuccugcacgguccagugccagaccgagaagggcgggcugaacaccacccuccccuuccagaacgugucgaaguacgcguucgggaacugcuccaaguacgugggcgucaagucgcugaagcuggccguggggcuccggaacgugcccucccgcagcucccggggccuguucggcgccaucgccggguucaucgagggcggguggucgggccuggucgccgggugguacggcuuccagcacuccaacgaccagggcguggggauggcggccgaccgcgacucgacgcagaaggccaucgacaaggugaccuccaaggucaacaauaucguggacaagaugaacaagcaguacgagaucaucgaccacgaguucucggagguggagacccggcucaacaugaucaacaacaagaucgacgaccagauccaggacaucugggccuacaacgccgagcugcugguccuccuggagaaccagaagacccuggacgagcacgacgcgaacgugaacaaccucuacaacaaggucaagcgcgcccugggcuccaacgccguggaggacgggaagggcugcuucgagcuguaccacaagugcgacgaccagugcauggagacgauccggaacgggaccuacaaccgccgcaaguaccaggaggagucgaagcucgagcggcagaagaucgagggcgugaagcuggaguccgagggcaccuacaagauccugaccaucuacucgaccgucgccuccucgcucgugaucgccaugggguucgcggccuuccuguucugggccauguccaacggcagcugccgccggaacaucugcaucuga

SEQ ID NO: 10520 - RNA, 1683 nt, Artificial Sequence
  derived and/or modified CDS sequence (AUadapt) from InfluenzaA__AGQ81100__HA
auggagaccgugagucugaucaccaugcuccuggucgccacggugaucaacgccgacaagaucugcaucggcuaccaguccaccaacucgaccgagaccguggacacgcugaccgagaacaacguccccgugacccacgcgaaggagcuccugcacaccgagcacaacgggaugcugugcgccacgaaccucggccacccgcugauccuggacacgugcaccaucgaggggcucaucuacggcaaccccuccugcgaccugcugcucgggggccgcgaguggucguacaucguggagcggcccuccgccgucaacggccugugcuaccccgggaacguggagaaccuggaggagcuccgcagccuguuuuccucggccuccucguaccagcggauccagaucuucccggacaccaucuggaacguguccuacucgggcaccuccaaggccugcagcgacuccuucuaccgcucgaugcgguggcugacccagaagaacaacgcguaccccauccaggacgcccaguacaccaacaaccgcgagaagaacauccucuucaugugggggaucaaccacccgcccaccgacacggcccagaccaaccuguacacccggaccgacacgaccaccuccgucgccaccgaggagaucaaccgcacguuuaagccccugaucggcccccggccccucgugaacgggcugcagggccgcaucgacuacuacuggucggugcugaagcccggccagacccuccggauccgcuccaacgggaaccugaucgcgccgugguacggccacauccugagcggggagucgcacggccggauccucaagaccgaccugaagcgcggcuccugcaccguccagugccagacggagaagggcgggcugaacaccacccuccccuuccagaacgugucgaaguacgccuucgggaacugcuccaaguacgugggcgucaagucgcugaagcuggccguggggcuccggaacgugcccucccgcagcucccggggccuguucggcgccaucgccggguucaucgagggcggguggucgggccuggucgcggggugguauggcuuccagcacuccaacgaccagggcguggggauggccgccgaccgcgacucgacccagaaggccaucgacaagaucacguccaaggugaacaacaucgucgacaagaugaacaagcaguacgagaucaucgaccacgaguucucggagguggagacccggcucaacaugaucaacaacaagaucgacgaccagauccaggacaucugggccuacaacgcggagcugcuggugcuccuggagaaccagaagacccuggacgagcacgacgccaacgucaauaaccucuacaacaaggugaagcgcgcccugggcuccaacgccgucgaggacgggaagggcugcuucgagcuguaccacaagugcgacgaccagugcauggagaccauccggaacgggacguacaaccgccgccgguaccaggaggagagcaagcucgagcgccagaagaucgagggcgugaagcuggaguccgagggcaccuacaagauccugaccaucuacucgaccguggccuccucgcucgucaucgcgaugggguucgccgccuuccuguucugggccauguccaacggcagcugccggcgcaacaucugcaucuga

SEQ ID NO: 10521 - RNA, 1683 nt, Artificial Sequence
  derived and/or modified CDS sequence (AUadapt) from InfluenzaA__AGQ81123__HA
auggagguggucagucugaucaccauccuccuggugaucaccguguccaacgccgacaagaucugcaucggcuaccagucgacgaacuccaccgagaccgucaacacccugacggaggacaacgugcccgugacccacgccaaggagcuccugcacaccgagcacaacgggaugcugugcgcgaccaaccucggccgcccgcugauccuggacacgugcaccaucgaggggcucaucuacggcaaucccagcugcgaccugcugcucgggggccgggagugguccuacaucgucgagcgccccucggccgugaacggccugugcuaccccgggaacguggagaaccuggaggagcuccggucccuguucagcuccgccucguccuaccagcgcauccagaucuucccggacaccaucuggaacgucagcuacuccggcaccaguaaggccugcuccgacagcuucuaccgguccaugcgcuggcugacgcagaagaacaacgccuaccccgugcaggacgcgcaguacaccaacaacaaggggcggaacauccucuucauguggggcaucaaccacccgcccaccgacaccgcccagacgaaccuguauacccgcaccgacaccacgaccucgguggccaccgaggacaucaaccggaccuucaagccccugaucgggccccgcccccucgucaacggccugcagggccggaucgacuacuacugggccgugcugaagcccgggcagacgcuccgcauccgguccaacggcaaccugaucgcgccgugguacgggcacauccugcucggcgagucgcacggccgcauccugaagaccgaccugaacagcggggacugugugguccagugccaguccgagcggggcgggcucaacaccacccugcccuuccacaacgugucgaaguacgccuucggcaacugccccaaguacgugggggucaagucccugaagcucgccgugggccugcgcaacgugcccgcccggagcacgcgcggccuguucggggccaucgcgggcuucaucgagggcgggugguccgggcucgucgccggcugguacggcuuccagcacucgaaugaccaggggaccggcauggccgccgaccgggacuccacccagaaggccaucgacaagaucaccagcaaggugaacaacaucguggacaagaugaacaagcaguacgagaucaucgaccacgaguucuccgagaucgagacgcgccugaacaugaucaacaacaagaucgacgaccagauccaggauaucugggcguacaacgccgagcugcucguccugcuggagaaccagaagacccucgacgagcacgacgccaacgugaacaaccuguacaacaaggucaagcgggcccuggggucgaacgccguggaggacggcaaggggugcuucgagcucuaccacaagugcgauaaccagugcauggagaccauccgcaacggcaccuacgaccgccggaaguacaaggaggagucccgccuggagcggcagaagaucgagggcgugaagcuggagagcgaggggacguacaagauccucaccaucuacuccaccgucgcgucgucccuggugaucgccaugggcuucgccgccuuccuguucugggccaugagcaacggguccugccgcugcaacaucugcaucuga

SEQ ID NO: 10522 - RNA, 1683 nt, Artificial Sequence
  derived and/or modified CDS sequence (AUadapt) from InfluenzaA__AGQ81124__HA
auggagguggccacccugaucaccauccuccuggucaucacgggcaguaacgccgacaagaucugcaucggguaccaguccaccaacucgaccgagaccguggacacgcugaccgagaacaacgugcccgucacccacgcgaaggagcuccugcacaccgagcacaacggcaugcugugcgccacgaaccucgggcgcccgcugauccuggacacgugcaccaucgagggccucaucuacgggaaccccuccugcgaccugccccuggagggccgggaguggaguuacaucguggagcgccccuccgccgugaacggcgucugcuacccggggaacguggagaaccucgaggagcugcggucgcuguucuccagcgccuccucguaccagcgcauccagaucuuccccgacuccaucuggaacgugucguacuccggcaccucgaaggccugcuccgacucguucuaccggaauaugcgcuggcucacccagaaggacaacaacuaccccguccaggacgcgcaguacaccaacaaccgggggaagaacauccuguucauguggggcaucaaccacccgcccaccgacaccgcccagacgaaccuguacacccgcaccgacaccacgaccuccguggccaccgaggacaucaaccggaccuucaagccccucaucgggccccgcccccuggugaacggccugcagggccggaucgacuacuauugggccguccucaagccggggcagacgcugcgcgugcggagcaacggcaaccugaucgcgcccugguacgggcacauccuccugggcgagucccacggccgcauccugaagaccgaccucaagucggggaacugcgugguccagugccagaccgagcggggcgggcugaacaccacgcugcccuuccacaacgugucgaaguacgccuucggcaacugccccaaguacaucggggugaagucccucaagcuggccgucggccugcgcaaugugccggcccggucgucccgcggccucuucggggccaucgcgggcuucaucgagggcggguggucggggcugguggccggcugguacggcuuccagcacuccaacgaccaggggaccggcauggccgccgaccgggacagcacccagaaggccaucgacaagaucaccuccaaggucaacaacaucguggacaagaugaacaagcaguacgagaucaucgaccacgaguucucggagaucgagacgcgccugaauaugaucaacgacaagaucgacgaccagauccaggacaucugggcguacaacgccgagcuccuggugcugcucgagaaccagaagacccuggacgagcacgacgccaacgucaacaaccuguacaacaaggugaagcgggcccucggguccaacgccgucgaggacggcaaggggugcuucgaccuguaccauaagugcgacaaccagugcauggagaccauccgcaacggcaccuacaaccgccggaaguaccagaaggagucgcgccuggagcggcagaagaucgagggcgugaagcucgaguccgaggggacguacaagauccugaccaucuacucgaccguggcguccucgcuggucaucgccaugggcuucgccgccuuccucuucugggccauguccaacgggagcugccgcugcaacaucugcaucuga

SEQ ID NO: 10523 - RNA, 1683 nt, Artificial Sequence
  derived and/or modified CDS sequence (AUadapt) from InfluenzaA__AGQ81125__HA
auggagguggccacccugaucaccauccuccuggucaucacgggcaguaacgccgacaagaucugcaucggguaccaguccaccaacucgaccgagaccguggacacgcugaccgagaacaacgugcccgucacccacgcgaaggagcuccugcacaccgagcacaacggcaugcugugcgccacgaaccucgggcgcccgcugauccuggacacguguaccaucgagggccucaucuacgggaaccccuccugcgaccugccccuggagggccgggaguggagcuacaucguggagcgccccuccgccgugaacggcgucugcuacccggggaacguggagaaccucgaggagcugcggucgcuguucuccagcgccuccucguaccagcgcauccagaucuuccccgauuccaucuggaacgugucguacuccggcaccagcaaggccugcuccgacucguucuaccgguccaugcgcuggcucacccagaaggacaacaacuaccccguccaggacgcgcaguacaccaacaaucgggggaagaacauccuguucauguggggcaucaaccacccgcccaccgacaccgcccagacgaaccuguacacccgcaccgacaccacgaccagcguggccaccgaggacaucaaccggaccuucaagccccucaucgggccccgcccccuggugaacggccugcagggccggaucgacuacuacugggccguccucaagccggggcagacgcugcgcgugcgguccaacggcaaucugaucgcgcccugguacgggcacauccuccugggcgugucgcacggccgcauccugaagaccgaccucaagucggggaacugcgucgugcagugccagaccgagcggggcgggcugaacaccacgcugcccuuccacaacguguccaaguacgccuucggcaacugucccaaguacaucggggucaagagccucaagcuggccgugggccugcgcaacgugccggcccgguccucgcgcggccucuucggggccaucgcgggcuucaucgagggcgggugguccgggcuggucgccggcugguacggcuuccagcacagcaacgaccaggggaccggcauggccgccgaccgggacuccacccagaaggccaucgacaagaucaccucgaaggugaacaauaucguggacaagaugaacaagcaguacgagaucaucgaccacgaguucuccgagaucgagacgcgccugaacaugaucaacgacaagaucgacgaccagauccaggacaucugggcguacaacgccgagcuccugguccugcucgagaaccagaagacccuggacgagcaugacgccaacgugaacaaccuguacaacaaggucaagcgggcccucgggucgaacgccguggaggacggcaaggggugcuucgaccuguaccacaagugcgacaaccaguguauggagaccauccgcaacggcaccuacaaccgccggaaguaccaggaggagucccgccuggagcggcagaagaucgagggcgugaagcucgagagcgaggggacguacaagauccugaccaucuacuccaccgucgcgucgucccuggugaucgccaugggcuucgccgccuuccucuucugggccaugagcaacggguccugccgcugcaacaucugcaucuga

SEQ ID NO: 10524 - RNA, 1683 nt, Artificial Sequence
  derived and/or modified CDS sequence (AUadapt) from InfluenzaA__AGQ81126__HA
auggagaccaucagucugaugaccauccuccugaucacgaccgccuccaacgccgacaagaucugcaucggccaccagucgaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccucggccgucaacgggaccugcuaucccggcaacguggagaaccuggaggagcugcgcacccucuucuccagcgccuccucguaccagcggauccagaucuucccggacaccaucuggaacgugacguacaccggcaccucccgcucgugcuccggcagcuucuaccgguccaugcgcuggcugacccagaaguccggguucuaccccguccaggacgccaaguacacgaacaaccggggcaagaacauccuguucgugugggggauccaccacccccauaccuacaccgaccagaccacgcucuacauccgcaacgacaccaccaccucggugacgaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacgugcugucgggcggcucgcacgggcgcauccugaagaccgaccucaagggcgggaacugcgucgugcagugccagacggagaagggcggguucaauuccacccugcccuuccacaacaucagcaaguacgccuucgggaccugcccgaaguacgugaaggucaacucccugaagcucgccaucggccugcggaacgugcccgcccgcucgaaccggggccuguucggcgcgaucgccggguucaucgagggcggguggcccggccucguggccggcugguacggguuccagcacuccaacgaccagggcgucgggauggccgccgaccgcgacagcacccagaaggcgguggacaagaucacguccaaggugaacaacaucgucgauaagaugaacaagcaguacgagaucaucgaccacgaguucucggagguggagacccggcugaacaugaucaacaacaagaucgacgaccagauccaggacaucugggccuacaacgccgagcugcucguccugcuggagaaccagaagacccucgacgagcacgacgccaacgugaacaaccuguacaacaaggugaagcgcgcccugggcuccaacgcgauggaggacgggaagggcuguuucgagcucuaccacaagugcgacgaccagugcauggagaccauccggaacggcaccuacaaccgccgcaaguaccgggaggagucgcgccuggagcagcagcggaucgagggggucaagcuggaguccgagggcacguacaagauccucaccaucuacagcaccguggccuccucgcuggugcuggccaugggguucgccgccuuccucuucugggcgauguccaacggcagcugccgcugcaacaucugcaucuga

SEQ ID NO: 10525 - RNA, 1683 nt, Artificial Sequence
  derived and/or modified CDS sequence (AUadapt) from InfluenzaA__AGQ81127__HA
auggagguggccacccugaucaccauccuccugcugaucacgggcaguaacgccgacaagaucugcaucggguaccaguccaccaacucgaccgagaccgucgacacgcucaccgagaacaacgugcccgugacccacgcgaaggagcugcugcacaccgagcacaacggcaugcucugcgccacgaaccuggggcgcccgcugauccucgacacgugcaccaucgagggccugaucuacgggaaucccuccugcgaccugccccucgagggccgggaguggucguacaucgucgagcgccccuccgccgugaacggcgugugcuacccggggaacgucgagaaccuggaggagcugcggagccucuucuccucggccuccucguaccagcgcauccagaucuuccccgacuccaucuggaacgugagcuacuccggcaccaguaaggccugcuccgacucguucuaccgguccaugcgcuggcugacccagaagaacaacaacuaccccgugcaggacgcgcaguacaccaacaaccgggggaagaacauccuguucauguggggcaucaaccacccgcccaccgacaccgcccagacgaaccucuauacccgcaccgacaccacgaccagcgucgccaccgaggacaucaaccggaccuucaagccccugaucgggccccgcccccuggugaacggccuccagggccggaucgacuacuacugggccgugcugaagccggggcagacgcugcgcguccgguccaacggcaaccucaucgcgcccugguacgggcacauccugcugggcgagucgcacggccgcauccucaagaccgaccucaagucggggaacugcguggugcagugucagaccgagcggggcgggcugaacaccacgcugcccuuccacaacgucuccaaguacgccuucggcaacugccccaaguacaucggggucaagucgcugaagcuggccgugggccuccgcaacgugccggcccgguccagccgcggccuguucggggccaucgcgggcuucaucgagggcgggugguccgggcugguggccggcugguacggcuuccagcacucgaaugaccaggggaccggcauggccgccgaccgggacuccacccagaaggccaucgacaagaucaccucgaaggugaacaacaucgucgacaagaugaacaagcaguacgagaucaucgaccacgaguucuccgagaucgagacgcgccucaacaugaucaacgacaagaucgacgaccagauccaggacaucugggcguauaacgccgagcugcuggugcuccuggagaaccagaagacccuggacgagcacgacgccaacgugaacaaccucuacaacaaggucaagcgggcccuggggagcaacgccguggaggacggcaaggggugcuucgaccuguaccacaagugcgauaaccagugcauggagaccauccgcaacggcaccuacaaccgccggaaguaccaggaggagucccgccucgagcggcagaagaucgagggcgucaagcuggagucggaggggacguacaagauccugaccaucuacuccaccguggcgucgucccucgugaucgccaugggcuucgccgccuuccuguucugggccaugagcaacggguccugccgcugcaacaucugcaucuga

SEQ ID NO: 10526 - RNA, 1683 nt, Artificial Sequence
  derived and/or modified CDS sequence (AUadapt) from InfluenzaA__AGQ81128__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacguguaccaucgagggccugaucuacgggaaccccuccugcgaccucccccuggagggccgggaguggucguacaucgucgagcgccccuccgccgugaacggcgugugcuacccggggaacgucgagaaccuggaggagcuccggagccuguucuccucggccuccucguaccagcgcauccagaucuuccccgauuccaucuggaacgugagcuacuccggcaccucgaaggcgugcuccgacucguucuaccgguccaugcgcuggcugacccagaagaacaacaacuaccccgugcaggacgcccaguacaccaacaaccgggggaagaauauccucuucauguggggcaucaaccacccgcccaccgacaccgcccagacgaaccuguacacccgcaccgacaccacgaccagcgucgccaccgaggacaucaaccggaccuucaagccccugaucgggccccgcccccucgugaacggccugcagggccggaucgacuacuacugggcggugcugaagccggggcagacgcuccgcguccgguccaacggcaaucugaucgcccccugguacgggcacauccugcucggcgagucgcacggccgcauccugaagaccgaccucaagucggggaacugcguggugcagugccagaccgagcggggcgggcugaacaccacgcugcccuuccacaacgucuccaaguacgccuucggcaacugccccaaguauaucggggucaagucgcugaagcucgccgugggccugcgcaacgugccggcccgguccagccgcggccuguucggggcgaucgccggcuucaucgagggcgggugguccgggcucguggccggcugguacggcuuccagcacucgaacgaccaggggaccggcauggccgccgaccgggacuccacccagaaggcgaucgacaagaucaccucgaaggugaacaacaucgucgauaagaugaacaagcaguacgacaucaucgaccacgaguucuccgagaucgagacgcgccugaacaugaucaacgacaagaucgacgaccagauccaggacaucugggccuacaacgccgagcugcucgugcugcuggagaaccagaagacccucgacgagcaugacgccaacgugaacaaccuguacaacaaggucaagcgggcccuggggagcaacgcgguggaggacggcaaggggugcuucgaccucuaccacaagugcgacaaccaguguauggagaccauccgcaacggcaccuacaaccgccggaaguaccaggaggagucccgccuggagcggcagaagaucgagggcgucaagcuggagucggaggggacguacaagauccucaccaucuacuccaccguggccucgucccugguggucgccaugggcuucgccgccuuccuguucugggcgaugagcaacggguccugccgcugcaacaucugcaucuga

SEQ ID NO: 10527 - RNA, 1683 nt, Artificial Sequence
  derived and/or modified CDS sequence (AUadapt) from InfluenzaA__AGQ81130__HA
auggagaccgugucgcugaucaccauccuccuggucgugacgaucggcaacgccgacaagaucugcaucggguaccaguccaccaacucgaccgagaccguggacacgcugaccgagaacaacguccccgugacccacgccaaggagcuccugcacaccgagcacaacggcaugcugugcgcgacgucccucgggcacccgcugauccuggacacgugcaccaucgagggccucaucuacgggaaccccucgugcgaccugcugcucggcggccgcgagugguccuacaucguggagcggcccucggccgucaacgggcugugcuaccccggcaacguggagaaccuggaggagcuccgcucccuguucucguccgcccggagcuaccagcgcauccagaucuucccggacaccaucuggaacguguccuacucggggaccuccaaggccugcucggacuccuucuaccggucgaugcgcuggcugacccagaagaacaacgccuaccccauccaggacgcgcaguacaccaacaaccaggagaagaacauccucuucauguggggcaucaaccacccgcccaccgacacgguccagaccaaccuguacacccggaccgacacgaccaccuccguggccaccgaggagaucaaccgcacguucaagccccugaucgggccccggccccucgugaacggccugcagggccgcaucgacuacuacuggucgguccugaagcccgggcagacccuccggauccgcuccaacggcaaccugaucgccccgugguacgggcacauccugagcggcgagucgcacggccggauccucaagaccgaccugaagcgcggguccugcaccgugcagugccagacggagaagggcgggcugaacaccacccuccccuuccagaacgugucgaaguacgccuucggcaacugcuccaaguacaucgggaugaagucccugaagcuggcggucggccuccggaacgugcccucgcgcucgucccggggccuguucggggccaucgccggcuucaucgagggcggguggagcgggcugguggccggcugguacggcuuccagcacuccaacgaccagggggucggcauggccgcggaccgcgacucgacccagaaggccaucgacaagaucacguccaaggugaacaacaucguggacaagaugaacaagcaguacgagaucaucgaccacgaguucucggaggucgagacccggcucaacaugaucaacaacaagaucgacgaccagauccaggacaucugggccuacaacgccgagcugcuggugcuccuggagaaccagaagacccuggacgagcacgacgccaacgugaacaaccucuacaacaaggucaagcgcgcgcugggguucaacgccguggaggacggcaaggggugcuucgagcuguaccacaagugcgacgaccagugcauggagaccauccggaacggcacguacaaccgccgcaaguaccaggaggaguccaagcucgagcggcagaagaucgagggcgucaagcuggagucggaggggaccuacaagauccugaccaucuacuccaccguggccucgucccucgugaucgccaugggcuucgccgcguuccuguucugggccaugagcaacggguccugccgcugcaacaucugcaucuga

SEQ ID NO: 10528 - RNA, 1683 nt, Artificial Sequence
  derived and/or modified CDS sequence (AUadapt) from InfluenzaA__AGQ81132__HA
auggagaccaucagucugaugaccauccuccugaucacgaccgccuccaacgccgacaagaucugcaucggccaccagagcaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccaguugcgaccugcugcucgaggggcgcgagugguccuacaucguggagcggcccagcgccgucaacgggaccugcuaccccggcaacguggagaaccuggaggagcugcgcacccucuucuccucggccuccagcuaccagcggauccagaucuucccggacaccaucuggaacgugacguacaccggcaccucccgcucgugcuccggcaguuucuaccgguccaugcgcuggcugacccagaaguccggguucuaccccguccaggacgccaaguacacgaacaaccggggcaagaacauccuguucgugugggggauccaccacccccacaccuacaccgaccagaccacgcucuacauccgcaacgacaccaccaccagugugacgaccgaggagcugaaccggaucuucaagcccgucaucgugccgcgccugcucgugaacggccagcagggccggaucgacuacuacuggagcguccugaagcccgggcagacccugcgcgugcgguccaacggcaaccucaucgcgcccugguacgggcacgugcugucgggcggcagccacgggcgcauccugaagaccgaccucaagggcgggaacugcgucgugcagugccagacggagaagggcggguucaauuccacccugcccuuccacaacaucucgaaguacgccuucgggaccugcccgaaguacgugaaggucaacucccugaagcucgccaucggccugcggaacgugcccgcccgcagcaaccggggccuguucggcgcgaucgccggguucaucgagggcggguggcccggccucguggccggcugguacggguuccagcacuccaacgaucagggcgucgggauggccgccgaccgcgacucgacccagaaggcgguggacaagaucacguccaaggugaacaacaucgucgacaagaugaaccggcaguacgagaucaucgaccacgaguucagcgagguggagacccgccugaacaugaucaacaacaagaucgacgaccagauccaggacaucugggccuauaacgccgagcugcucguccugcuggagaaccagaagacccucgacgagcacgacgccaacgugaacaaccuguacaacaaggugaagcgggcccugggcuccaacgcgauggaggacgggaagggcugcuucgagcucuaccacaagugcgacgaucagugcauggagaccauccgcaacggcaccuacaaccgccggaaguaccgcgaggagucgcggcuggagcagcagcgcaucgagggggucaagcuggaguccgagggcacguacaagauccucaccaucuacagcaccguggccuccucgcuggugcuggccaugggguucgccgccuuccucuucugggcgauguccaacggcagcugccggugcaacaucugcaucuga

SEQ ID NO: 10529 - RNA, 1683 nt, Artificial Sequence
  derived and/or modified CDS sequence (AUadapt) from InfluenzaA__AGQ81133__HA
auggagaccaucagucugaugaccauccuccugaucacgaccgccuccaacgccgacaagaucugcaucggccaccagucgaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuacaucguggagcggcccucggccgucaacgggaccugcuaccccggcaacguggagaaccuggaggagcugcgcacccucuucuccucggccuccagcuaccagcggauccagaucuucccggacaccaucuggaacgugacguacaccgggaccucccgcucgugcuccggcaguuucuaccgguccaugcgcuggcugacccagaaguccggguucuaccccguccaggacgccaaguacacgaacaaccggggcaagaacauccuguucgugugggggauccaccacccccacaccuacaccgaccagaccacgcucuacauccgcaacgacaccaccaccagcgugacgaccgaggagcugaaccggaucuucaagcccgucaucgugccgcgccugcucgugaacggccagcagggccggaucgacuacuacuggucgguccugaagcccgggcagacccugcgcgugcgguccaacggcaaccucaucgcgcccugguacgggcacauccugucgggcggcagccacgggcgcauccugaagaccgaccucaaguccggcaacugcgugguccagugccagacggagaagggcggcuucaauucgacccugcccuuccacaacaucuccaaguacgccuucgggaccugcccgaaguacgugaaggugaacucgcugaagcucgccaucggccugcggaacguccccgcccgcuccaaccggggccuguucggggcgaucgccggcuucaucgagggcggguggcccgggcucguggccggcugguacggcuuccagcacagcaacgaccagggggugggcauggccgccgaccgcgacuccacccagaaggcggucgacaagaucacgucgaaggugaacaacaucguggacaagaugaacaagcaguacgagaucaucgaccacgaguucuccgaggucgagacccggcugaacaugaucaacaacaagaucgacgaccagauccaggacaucugggccuauaacgccgagcugcucgugcugcuggagaaccagaagacccucgacgagcacgacgccaacgucaacaaccuguacaacaaggugaagcgcgcccuggggucgaacgcgauggaggacggcaaggggugcuucgagcucuaccacaagugcgacgaccagugcauggagaccauccggaacggcaccuacaaccgccgcaaguaccgggaggagucccgccuggagcagcagcggaucgagggcgugaagcuggagagcgaggggacguacaagauccucaccaucuacuccaccgucgccucgucccuggugcuggccaugggcuucgccgccuuccucuucugggcgaugagcaacggguccugccgcugcaacaucugcaucuga

SEQ ID NO: 10530 - RNA, 1683 nt, Artificial Sequence
  derived and/or modified CDS sequence (AUadapt) from InfluenzaA__AGQ81134__HA
auggagaccaucagucugaugaccauccuccugaucacgaccgccuccaacgccgacaagaucugcaucggccaccagucgaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuauaucguggagcggcccucggccgccaacgggaccugcuaccccggcaacgucgagaacccggaggagcugcgcacccuguucuccagcgccuccucguaccagcggauccagaucuuccccgacaccaucuggaacgugacguacaccgggaccucccgcucgugcuccggcagcuucuaccgguccaugcgcuggcucacccagaaguccggguucuaccccgugcaggaugcgaaguacacgaacaaccggggcaagaacauccuguucgucugggggauccaccacccccacaccuacaccgaccagaccacgcuguacauccgcaacgacaccaccaccucggugacgaccgaggagcucaaccggaucuucaagccggugaucgucccccgccugcuggugaacggccagcagggccggaucgacuacuacuggagcgugcucaagcccgggcagacccugcgcguccgguccaauggcaaccugaucgcccccugguacgggcacgugcucucgggcggcucgcacgggcgcauccugaagaccgaccugaaguccggcaacugcgugguccagugccagacggagaagggcggcuucaacagcacccucccguuccacaacaucuccaaguacgccuucgggaccugccccaaguacgugaaggugaacucgcugaagcuggccaucggccuccggaauguccccgcgcgcuccaaccggggccuguucggggccaucgccggcuucaucgagggcggguggcccgggcugguggccggcugguacggcuuccagcacagcaacgaccagggggugggcauggccgcggaccgcgacuccacccagaaggccgucgacaagaucacgucgaaggugaacaacaucguggacaagaugaacaagcaguacgagaucaucgaccacgaguucuccgaggucgagacccggcucaauaugaucaacaacaagaucgacgaccagauccaggacaucugggccuacaacgccgagcugcuggugcuccuggagaaccagaagacccuggacgagcacgacgccaacgucaacaaccucuacaacaaggugaagcgcgcgcuggggucgaacgccauggaggacggcaaggggugcuucgagcuguaucacaagugcgacgaccagugcauggagaccauccggaacggcaccuacaaccgccgcaaguaccgggaggagucccgccucgagcagcagcggaucgagggcgugaagcuggagagcgaggggacguacaagauccugaccaucuacuccaccgucgccucgucccucgugcuggccaugggcuucgccgcguuccuguucugggccaugagcaacggguccugccgcugcaacaucugcaucuga

SEQ ID NO: 10531 - RNA, 1683 nt, Artificial Sequence
  derived and/or modified CDS sequence (AUadapt) from InfluenzaA__AGQ81135__HA
auggagguggccaccaucaucaccauccugcucgucaucacgggcaguaacgccgacaagaucugcaucggguaccaguccaccaacucgaccgagaccguggacacgcugaccgagaacaacgugcccgucacccacgcgaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggucguacaucguggagcgccccuccgccgugaacggcgucugcuacccggggaacguggagaaccuggaggagcuccggucgcuguucuccucggccuccucguaccagcgcauccagaucuuccccgacuccaucuggaacgugucguacuccggcaccucgaaggccugcuccgacucguucuaccgguccaugcgcuggcugacccagaagaacaacaacuaccccguccaggacgcgcaguacaccaacaaccgggggaagaauauccucuucauguggggcaucaaccacccgcccaccgacaacgcccagaccaaccuguacacgcgcaccgacaccaccacgucgguggccaccgaggacaucaaccggaccuucaagccccugaucgggccccgcccccucgugaacggccugcagggccggaucgacuacuacugggccguccugaagccggggcagacccuccgcgugcgguccaacggcaaccugaucgcgcccugguacgggcacauccugcucggcgagucgcacggccgcauccugaagacggaccucaagucggggaacugcgugguccagugccagaccgagcggggcgggcugaacaccacccugcccuuccacaacguguccaaguacucguucggcaacugccccaaguacaucggggugaagucccugaagcucgccgucggccugcgcaacgugccggcccggucgucccgcggccuguucggggccaucgccggcuucaucgagggcggguggucggggcucguggcgggcugguacggcuuccagcacuccaacgaccaggggacgggcauggccgccgaccgggacucgacccagaaggccaucgacaagaucaccuccaaggucaacaauaucguggacaagaugaacaagcaguacgagaucaucgaccacgaguucaacgagaucgagacccgccugaacaugaucaacaacaagaucgacgaccagauccaggacaucugggccuacaacgcggagcugcucgugcugcuggagaaccagaagacgcucgacgagcacgacgccaacgucaacaaccuguacaacaaggugaagcgggcccuggggucgaacgccgucgaggacggcaaggggugcuucgaccucuaccacaagugcgacaaccagugcauggagaccauccgcaacggcaccuacaaccgccggaaguaccaggaggagucccgccuggagcggcagaagaucgagggcgugaagcuggagucggaggggaccuacaagauccucacgaucuacuccaccguggccucgucccuggucaucgcgaugggcuucgccgccuuccuguucugggccaugagcaacggguccugccgcugcaacaucugcaucuga

SEQ ID NO: 10532 - RNA, 1683 nt, Artificial Sequence
  derived and/or modified CDS sequence (AUadapt) from InfluenzaA__AGQ81136__HA
auggagaccaucagucugaugaccauccuccugaucacgaccgccuccaacgccgacaagaucugcaucggccaccagucgaccaacuccaccgagacgguggacacccugaccgagaccaacguccccgugacgcacgcgaaggagcuccugcagaccgagcacaacgggaugcugugcgccaccaaccucggccacccgcugauccuggacacgugcaccaucgaggggcucaucuacggcaaccccagcugcgaccugcugcucgaggggcgcgagugguccuauaucguggagcggcccucggccgucaacgggaccugcuaccccggcaacguggagaaccuggaggagcugcgcacccucuucuccagcgccuccucguaccagcggauccagaucuucccggacaccaucuggaacgugacguacaccggcaccucccgcagcugcuccggcucguucuaccgguccaugcgcuggcugacccagaaguccggguucuaccccguccaggaugccaaguacacgaacaaccggggcaagaacauccuguucgugugggggauccaccacccccacaccuacaccgaccagaccacgcucuacauccgcaacgacaccaccaccagcgugacgaccgaggagcugaaccggaucuucaagcccgucaucgugccgcgccugcucgugaacggccagcagggccggaucgacuacuacuggucgguccugaagcccgggcagacccugcgcgugcgguccaauggcaaccucaucgcgcccugguacgggcacgugcugucgggcggcagccacgggcgcauccugaagaccgaccucaagggcgggaacugcgucgugcagugccagacggagaagggcggguucaacuccacccugcccuuccacaacaucucgaaguacgccuucgggaccugcccgaaguacgugaaggucaacucccugaagcucgccaucggccugcggaacgugcccgcccgcaguaaccggggccuguucggcgcgaucgccggguucaucgagggcggguggcccggccucguggccggcugguacggguuccagcacuccaacgaccagggcgucgggauggccgccgaccgcgacucgacccagaaggcgguggacaagaucacguccaaggugaacaacaucgucgacaagaugaaccggcaguacgagaucaucgaccacgaguucagcgagguggagacccgccugaauaugaucaacaacaagaucgacgaccagauccaggacaucuggaccuacaacgccgagcugcucguccugcuggagaaccagaagacccucgacgagcacgacgccaacgugaacaaccuguacaacaaggugaagcgggcccugggcuccaacgccauggaggacgggaagggcugcuucgagcucuaccauaagugcgacgaccagugcauggagaccauccgcaacggcacguacaaccgccggaaguaccgcgaggagucgcggcuggagcagcagcgcaucgagggggucaagcuggaguccgagggcaccuacaagauccucaccaucuacagcaccguggcguccucgcuggugcuggccaugggguucgccgccuuccucuucugggccauguccaacggcagcugccggugcaacaucugcaucuga

SEQ ID NO: 10533 - RNA, 1683 nt, Artificial Sequence; identical to SEQ ID NO: 10528
  derived and/or modified CDS sequence (AUadapt) from InfluenzaA__AGQ81137__HA

SEQ ID NO: 10534 - RNA, 1683 nt, Artificial Sequence
  derived and/or modified CDS sequence (AUadapt) from InfluenzaA__AGQ81138__HA
auggaggccgccaccaucaucaccauccugcucgcgaucacgggcaguaacgccgacaagaucugcaucggguaccaguccaccaacucgaccgagaccguggacacgcugaccgagaacaacguccccgugacccacgccaaggagcugcuccacaccgagcacaacggcaugcugugcgccacgaaccuggggcgcccgcucauccuggacacgugcaccaucgagggccugaucuacgggaaucccuccugcgaccucccccuggagggccgggaguggucguacaucguggagcgccccuccgccgucaacggcgugugcuacccggggcacguggagaaccuggaggagcuccggucgcuguucuccagcgcguccucguaccagcgcguccagaucuuccccgacuccaucuggaacgugucguacuccggcaccaguaaggccugcuccgacucguucuaccgguccaugcgcuggcugacccagaagaacaacaacuaccccgugcaggacgcccaguacaccaacaacaaggggaagaacauccucuucauguggggcaucaaccacccgcccaccgacaccgcccagacgaaccuguauacccggaccgacaccacgaccagcgucgcgaccgaggacaucaaccgcaccuucaagccccugaucgggccccggccccucgugaacggccugcagggccgcaucgacuacuacugggccgugcugaagccggggcagacgcuccggguccgcuccaacggcaaccugaucgcccccugguacgggcacauccugcucggcgagucgcacggccggauccugaagaccgaccucaagucggggaacugcguggugcagugucagaccgagcgcggcgggcugaacaccacgcugcccuuccacaacgucuccaaguacgccuucggcaacugccccaaguacaucggggucaagucgcugaagcucgccgugggccugcggaacgugcacgcgcgcuccucgcggggccuguucggggccaucgccggcuucaucgagggcgggugguccgggcucguggccggcugguacggcuuccagcacagcaaugaccaggggaccggcauggccgcggaccgcgacuccacccagaaggccaucgacaagaucaccucgaaggugaacaacaucgucgacaagaugaacaagcaguacgagaucaucgaccacgaguucuccgagaucgagacgcggcugaacaugaucaacgacaagaucgacgaccagauccaggacaucugggccuauaacgccgagcugcucgugcugcuggagaaccagaagacccucgacgagcacgacgccaacgugaacaaccuguacaacaaggucaagcgcgcgcuggggucgaacgccguggaggacggcaaggggugcuucgaccucuaccacaagugcgauaaccagugcauggagaccauccggaacggcaccuacaaccgccgcaaguaccaggaggagucccggcuggagcgccagaagaucgagggcgucaagcuggagucggaggggacguacaagauccucaccaucuacuccaccguggccucgucccuggugaucgccaugggcuucgccgcguuccuguucugggccaugagcaacggguccugccggugcaacaucugcaucuga

SEQ ID NO: 10535 - RNA, 1683 nt, Artificial Sequence
  derived and/or modified CDS sequence (AUadapt) from InfluenzaA__AGQ81139__HA
auggagguggccaccaucaucaccauccugcucgucaucacgggcgggaaugccgacaagaucugcaucggcuaccagucgaccaacuccaccgagaccguggacacgcugaccgagaacaacgugcccgucacccacgcgaaggagcugcuccacaccgagcacaacgggaugcugugcgccacgaaccugggccgcccgcucauccuggacacgugcaccaucgaggggcugaucuacggcaaccccucgugcgaccucccccuggagggccgggagugguccuacaucguggagcgcucguccgccgugaacggggucugcuaccccggcaacguggagaaccuggaggagcuccggucgcuguucuccucggccuccucguaccagcgcauccagaucuucccggacuccaucuggaacgugagcuacuccgggaccucgaaggccuguuccgacucguucuaccgguccaugcgcuggcugacccagaagaacaacaacuaccccguccaggacgcgcaguacaccaacaaccggggcaagaacauccucuucaugugggggaucaaccacccgcccaccgacaacgcccagaccaaccuguacacgcgcaccgacaccaccacgucgguggccaccgaggacaucaaccggaccuucaagccccugaucggcccccgcccccucgugaacggccugcaggggcggaucgacuacuacugggccguccugaagcccggccagacccuccgcgugcgguccaacgggaaccugaucgcgccgugguacggccacauccugcucggcgagucgcacgggcgcauccugaagacggaccucaagucgggcaacugcgugguccagugucagaccgagcgcgggggccugaacaccacccugcccuuccacaacguguccaaguacucguucgggaacugccccaaguacaucggcgugaagucccugaagcucgccgucggccugcggaacgugcccgcccggagcucccgcgggcuguucggcgccaucgccggguucaucgagggcggguggucgggccucguggcgggcugguacggguuccagcacuccaacgaccagggcacggggauggccgccgaccgggacucgacccagaaggccaucgacaagaucaccuccaaggucaacaacaucguggacaagaugaacaagcaguacgagaucaucgaccacgaguucucggagaucgagacccgccugaacaugaucaacaacaagaucgacgaccagauccaggacaucugggccuauaacgcggagcugcucgugcugcuggagaaccagaagacgcucgacgagcacgacgccaacgucaacaaccuguacaacaaggugaagcgggcccugggcuccaacgccgucgaggacgggaagggcugcuucgaccucuaccacaagugcgacaaccagugcauggagaccauccgcaacggcaccuacaaccgccggaaguaccaggaggagucgcgccuggagcggcagaagaucgagggggugaagcuggaguccgagggcaccuacaagauccucacgaucuacucgaccguggccuccucgcuggucaucgcgaugggguucgccgccuuccuguucugggccauguccaacggcagcugccgcugcaacaucugcaucuga

SEQ ID NO: 10536 - RNA, 1683 nt, Artificial Sequence
  derived and/or modified CDS sequence (AUadapt) from InfluenzaA__AGQ81141__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacggaucuggggcgcccgcucauccuggacacgugcaccaucgagggccugaucuacgggaaccccuccugcgaccucccccuggagggccgggaguggucguacaucgucgagcgccccuccgccgugaacggcgugugcuacccggggaacgucgagaaccuggaggagcuccggagccuguucuccagugccuccucguaccagcgcauccagaucuuccccgacuccaucuggaacgugucguacuccggcaccagcaaggcgugcuccgacucguucuaccgguccaugcgcuggcugacccagaagaacaacaauuaccccgugcaggacgcccaguacaccaacaaccgggggaagaacauccucuucauguggggcaucaaccacccgcccaccgacaccgcccagacgaaccuguacacccgcaccgacaccacgaccucggucgccaccgaggacaucaaucggaccuucaagccccugaucgggccccgcccccucgugaacggccugcagggccggaucgacuacuacugggcggugcugaagccggggcagacgcuccgcguccgguccaacggcaaccugaucgcccccugguacgggcacauccugcucggcgagucgcacggccgcauccugaagaccgaccucaagagcgggaacugcguggugcagugucagaccgagcggggcgggcugaacaccacgcugcccuuccacaacgucuccaaguacgccuucggcaacugccccaaguacaucggggucaagucgcugaagcucgccgugggccugcgcaacgugccggcccggucccgccggggccuguucggggcgaucgccggcuucaucgagggcggguggaccgggcucguggccggcugguacggcuuucagcacucgaacgaccaggggaccggcauggccgccgaccgcgacuccacccagaaggcgaucgacaagaucacgucgaaggugaacaacaucgucgacaagaugaacaagcaguacgacaucaucgaccaugaguucuccgagaucgagacccggcugaacaugaucaacgacaagaucgacgaccagauccaggacaucugggccuacaacgccgagcugcucgugcugcuggagaaccagaagacccucgacgagcacgacgccaacgugaacaaucuguacaacaaggucaagggggcccugggcagcaacgcgguggaggacgggaagggcugcuucgaccucuaccacaagugcgacaaccagugcauggagaccauccgcaacggcacguauaaccgccggaaguaccaggaggagucccgccuggagcggcagaagaucgagggggucaagcuggagucggagggcaccuacaagauccucaccaucuacuccaccguggccucgucccuggugaucgccaugggguucgccgccuuccuguucugggcgaugagcaacggcuccugccgcugcaacaucugcaucuga

SEQ ID NO: 10537 - RNA, 1683 nt, Artificial Sequence
  derived and/or modified CDS sequence (AUadapt) from InfluenzaA__AGQ81143__HA
auggagguggccaccaucaucaccauccugcucgucaucacgggcaguaacgccgacaagaucugcaucggguaccaguccaccaacucgaccgagaccguggacacgcugaccgagaacaacgugcccgucacccacgcgaaggagcugcuccacaccgagcacaacggcaugcugugcgccacgaaccuggggcgcccgcucauccuggacacgugcaccaucgagggccugaucuacgggaaccccuccugcgaccucccccuggagggccgggaguggucguacaucguggagcgccccuccgccgugaacggcgucugcuacccggggaacguggagaaccuggaggagcuccggucgcuguucuccucggccuccucguaccagcgcauccagaucuuccccgacuccaucuggaacgugagcuacuccggcaccucgaaggccuguuccgacucguucuaccgguccaugcgcuggcugacccagaagaacaacaacuaccccguccaggacgcgcaguacaccaacaaccgggggaagaacauccucuucauguggggcaucaaccacccgcccaccgacaacgcccagaccaaccuguacacgcgcaccgacaccaccacgucgguggccaccgaggacaucaaccggaccuucaagccccugaucgggccccgcccccucgugaacggccugcagggccggaucgacuacuacugggccguccugaagccggggcagacccuccgcgugcgguccaacggcaaccugaucgcgcccugguacgggcacauccugcucggcgagucgcacggccgcauccugaagacggaccucaagucggggaacugcgugguccagugucagaccgagcggggcgggcugaacaccacccugcccuuccacaacguguccaaguacucguucggcaacugccccaaguacaucggggugaagucccugaagcucgccgucggccugcgcaacgugccggcccggagcucccgcggccuguucggggccaucgccggcuucaucgagggcggguggucggggcucguggcgggcugguacggcuuccagcacuccaacgaccaggggacgggcauggccgccgaccgggacucgacccagaaggccaucgacaagaucaccuccaaggucaacaacaucguggacaagaugaacaagcaguacgagaucaucgaccacgaguucucggagaucgagacccgccugaacaugaucaacaacaagaucgacgaccagauccaggacaucugggccuauaacgcggagcugcucgugcugcuggagaaccagaagacgcucgacgagcacgacgccaacgucaacaaccuguacaacaaggugaagcgggcccugggguccaacgccgucgaggacggcaaggggugcuucgaccucuaccacaagugcgacaaccagugcauggagaccauccgcaacggcaccuacaaccgccggaaguaccaggaggagucgcgccuggagcggcagaagaucgagggcgugaagcuggaguccgaggggaccuacaagauccucacgaucuacucgaccguggccuccucgcuggucaucgcgaugggcuucgccgccuuccuguucugggccauguccaacgggagcugccgcugcaacaucugcaucuga

SEQ ID NO: 10538 - RNA, 1683 nt, Artificial Sequence
  derived and/or modified CDS sequence (AUadapt) from InfluenzaA__AGQ81144__HA
auggaggccgccaccaucaucaccauccugcucguggucacgggcaguaacgcggacaagaucugcaucggguaccaguccaccaacucgaccgagaccguggacacgcugaccgagaacaacgugcccgucacccacgccaaggagcugcuccacaccgagcacaacggcaugcugugcgccacgaaccuggggcgcccgcucauccuggacacguguaccaucgagggccugaucuacgggaaccccuccugcgaccucccccuggagggccgggaguggucguacaucguggagcgccccuccgccgugaacggcgucugcuacccggggaacguggagaaccuggaggagcuccggagccuguucuccucggccuccucguaccagcgcauccagaucuuccccgauuccaucuggaacgugucguacggcgggaccuccaaggcgugcagcgacuccuucuaccggucgaugcgcuggcugacccagaagaacaacaacuaccccguccaggacgcccaguacaccaacaaucggggcaagaacauccucuucaugugggggaucaaccacccgcccaccgacaccgcccagacgaaccuguacacccgcaccgacaccacgaccuccguggccaccgaggacaucaaccggaccuucaagccccugaucggcccccgcccccucgugaacggccugcaggggcggaucgacuacuacugggcgguccugaagccgggccagacgcuccgcgugcggucgaacgggaaucugaucgcccccugguacggccacauccugcucggcgagucccacgggcgcauccugaagaccgaccucaagucgggcaacugcgugguccagugccagaccgagcgcgggggccugaacaccacgcugcccuuccacaacgugagcaaguacgccuucgggaacugucccaaguacaucggcgugaagucccugaagcucgccgucggccugcggaacaugccggcccggucgucccgcgggcuguucggcgcgaucgccggguucaucgagggcggguggucgggccucguggccggcugguacggguuccagcacuccaacgaccagggcaccgggauggccgccgaccgggacucgacccagaaggcgaucgacaagaucaccuccaaggugaacaacaucgucgauaagaugaacaagcaguacgagaucaucgaccacgaguucagcgagaucgagacgcgccugaacaugaucaacgacaagaucgacgaccagauccaggacaucugggccuacaacgccgagcugcucgugcugcuggagaaccagaagacccucgacgagcaugacgccaacgugaacaaccuguacaacaaggucaagcgggcccugggcuccaacgcgguggaggacgggaagggcugcuucgaccucuaccacaagugcgacaaccagugcauggagaccauccgcaauggcaccuacaaccgccggaaguaccaggaggagucgcgccuggagcggcagaagaucgagggggucaagcuggaguccgagggcacguacaagauccucaccaucuacucgaccguggccuccucgcuggugaucgccaugggguucgccgccuuccuguucugggcgauguccaacggcagcugccgcugcaacaucugcaucuga

SEQ ID NO: 10539 - RNA, 1683 nt, Artificial Sequence
  derived and/or modified CDS sequence (AUadapt) from InfluenzaA__AGQ81146__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggcaaggaguggucguacaucgucgagcggcccuccgccgugaacggcaugugcuacccggggaacguggagaaccuggaggagcuccgcucgcuguucuccucggccuccucguaccagcggauccagaucuuccccgacuccaucuggaacgucucguacuccggcaccucgaaggcgugcuccgacucguucuaccgcuccaugcgguggcugacccagaagaacaacaacuaccccgugcaggacgcccaguacaccaacaaucgcgggaagaacauccucuucauguggggcaucaaccacccgcccaccgacaccgcccagacgaaccuguacacccggaccgacaccaagacgucgguggccaccgaggagaucaaccgcaccuucaagccccugaucgggccccggccccucgucaacggccugcagggccgcaucgacuacuacugggcggugcugaagccggggcagacccuccgggugcgcuccaacggcaaccugaucgcccccugguacgggcacauccugcucggcgagucgcacggccggauccugaagacggaccucaagucggggaacugcgucgugcagugccagaccgagcgcggcgggcugaacaccacccugcccuuccacaacguguccaaguacgccuucggcaacugccccaaguacaucggggucaagucgcugaagcucgccgugggccugcggaacgugccggcccgcuccucgcggggccuguucggggcgaucgccggcuucaucgagggcgggugguccgggcucgucgccggcugguacggcuuccagcacucgaacgaccaggggacgggcauggccgccgaccgcgacuccacccagaaggcgaucgacaagaucaccucgaaggugaacaacaucguggauaagaugaacaagcaguacgagaucaucgaccacgaguucuccgagaucgagacccggcugaacaugaucaacgacaagaucgacgaccagauccaggacaucugggccuacaacgccgagcugcucguccugcuggagaaccagaagacgcucgacgagcacgacucgaacgugaacaaccuguacaacaaggugaagcgcgcccugggguccaacgccgucgaggacggcaaggggugcuucgaccucuaccacaagugcgacaaccagugcauggagaccauccggaacggcaccuacaaccgccgcaaguaccaggaggagucgcggcuggagcgccagaagaucgagggcgugaagcuggaguccgaggggaccuacaagauccucacgaucuacucgaccgucgcguccucgcuggugaucgccaugggcuucgccgccuuccuguucugggccauguccaacgggagcugccggugcaacaucugcaucuga

SEQ ID NO: 10540 - RNA, 1683 nt, Artificial Sequence
  derived and/or modified CDS sequence (AUadapt) from InfluenzaA__AGQ81147__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggcaaggaguggucguacaucgucgagcggcccuccgccgugaacggcaugugcuacccggggaacguggagaaccuggaggagcuccgcucgcuguucuccucggccuccucguaccagcggauccagaucuuccccgacuccaucuggaacgucucguacuccggcaccucgaaggcgugcuccgacucguucuaccgcuccaugcgguggcugacccagaagaacaacaacuaccccgugcaggacgcccaguacaccaacaaucgcgggaagaacauccucuucauguggggcaucaaccacccgcccaccgacaccgugcagacgaaccuguacacccggaccgacaccaagacgucggucgccaccgaggagaucaaccgcaccuucaagccccugaucgggccccggccccucgugaacggccugcagggccgcaucgacuacuacugggccgugcugaagccggggcagacccuccggguccgcuccaacggcaaccugaucgcgcccugguacgggcacauccugcucggcgagucgcacggccggauccugaagacggaccucaagucggggaacugcguggugcagugccagaccgagcgcggcgggcugaacaccacccugcccuuccacaacgucuccaaguacgccuucggcaacugccccaaguacaucggggucaagucgcugaagcucgccgugggccugcggaacgugccggcccgcuccucgcggggccuguucggggccaucgcgggcuucaucgagggcgggugguccgggcucguggccggcugguacggcuuccagcacucgaacgaccaggggacgggcauggccgccgaccgcgacuccacccagaaggccaucgacaagaucaccucgaaggugaacaauaucgucgacaagaugaacaagcaguacgagaucaucgaccacgaguucuccgagaucgagacccggcugaacaugaucaacgacaagaucgacgaccagauccaggacaucugggcguacaacgccgagcugcucgugcugcuggagaaccagaagacgcucgacgagcacgacgccaacgugaacaaccuguacaacaaggucaagcgcgcccuggggucgaacgccguggaggacggcaaggggugcuucgaccucuaccacaagugcgacaaccagugcauggagaccauccggaacggcaccuacaaccgccgcaaguaccaggaggagucccggcuggagcgccagaagaucgagggcgucaagcuggagucggaggggaccuacaagauccucacgaucuacuccaccguggcgucgucccuggugaucgccaugggcuucgccgccuuccuguucugggccaugagcaacggguccugccggugcaacaucugcaucuga

SEQ ID NO: 10541 - RNA, 1683 nt, Artificial Sequence
  derived and/or modified CDS sequence (AUadapt) from InfluenzaA__AGQ81148__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggcaaggaguggucguacaucgucgagcggcccuccgccgugaacggcaugugcuacccggggaacguggagaaccuggaggagcuccgcucgcuguucuccucggccuccucguaccagcggauccagaucuuccccgacuccaucuggaacgucucguacuccggcaccaguaaggcgugcuccgacucguucuaccgcuccaugcgguggcugacccagaagaacaacaacuaccccgugcaggacgcccaguacaccaacaaccgcgggaagaacauccucuucauguggggcaucaaccacccgcccaccgacaccgcccagacgaaccuguacacccggaccgacaccaagacgucgguggccaccgaggagaucaaccgcaccuucaagccccugaucgggccccggccccucgucaacggccugcagggccgcaucgacuacuacugggcggugcugaagccggggcagacccuccgggugcgcuccaacggcaaccugaucgcccccugguacgggcacauccugcucggcgagucgcacggccggauccugaagacggaccucaagucggggaacugcgucgugcagugucagaccgagcgcggcgggcugaacaccacccugcccuuccacaacguguccaaguacgccuucggcaacugccccaaguacaucggggucaagucgcugaagcucgccgugggccugcggaacgugccggcccgcuccucgcggggccuguucggggcgaucgccggcuucaucgagggcgggugguccgggcucgucgccggcugguacggcuuccagcacucgaacgaccaggggacgggcauggccgccgaccgcgacuccacccagaaggcgaucgacaagaucaccucgaaggugaacaacaucguggacaagaugaacaagcaguacgagaucaucgaccacgaguucuccgagaucgagacccggcugaacaugaucaacgacaagaucgacgaccagauccaggacaucugggccuauaacgccgagcugcucguccugcuggagaaccagaagacgcucgacgagcacgacgccaacgugaacaaccuguacaacaaggugaagcgcgcccuggggucgaacgcggucgaggacggcaaggggugcuucgaccucuaccacaagugcgacaaccagugcauggagaccauccggaacggcaccuacaaccgccgcaaguaccaggaggagucccggcuggagcgccagaagaucgagggcgugaagcuggagucggaggggaccuacaagauccucacgaucuacuccaccgucgccucgucccuggugaucgccaugggcuucgccgccuuccuguucugggcgaugagcaacggguccugccggugcaacaucugcaucuga

SEQ ID NO: 10542 - RNA, 1683 nt, Artificial Sequence
  derived and/or modified CDS sequence (AUadapt) from InfluenzaA__AGQ81149__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccggccacaacgggaugcugugcgccacgaaccugggccgcccgcucauccuggacacgugcaccaucgaggggcugaucuacggcaaucccuccugcgaccucccccuggagggccgggaguggucguacaucgucgagcgccccuccgccaucaacggggugugcuacccgggcaacguggagaaccuggaggagcuccggagccuguucuccucggccuccucguaccagcgcauccagaucuuccccgacuccaucuggaacgucucguacuccgggaccaguaaggcgugcuccgacucguucuaccgguccaugcgcuggcugacccagaagaacaacaacuaccccgugcaggacgcccaguacaccaacaaccggggcaagaacauccucuucaugugggggaucaaccacccgcccaccgacaccgcccagacgaaccuguauacccgcaccgacaccacgaccucgguggccaccgaggacaucaaccggaccuucaagccccugaucggcccccgcccccucgucaacggccugcaggggcggaucgacuacuacugggcggugcugaagccgggccagacgcuccgcgugcgguccaacgggaaccugaucgcccccugguacggccacauccugcucggcgagucgcacgggcgcauccugaagaccgaccucaagagcggcaacugcgucgugcagugucagaccgagcgcgggggccugaacaccacgcugcccuuccacaacguguccaaguacgccuucgggaacugccccaaguacaucggcgucaagucgcugaagcucgccgugggccugcggaacgugccggcccgguccucgcgcgggcuguucggcgcgaucgccggguucaucgagggcgggugguccggccucgucgccggcugguacggguuccagcacucgaaugaccagggcaccgggauggccgccgaccgggacuccacccagaaggcgaucgacaagaucaccagcaaggugaacaacaucguggacaagaugaacaagcaguacgagaucaucgaccacgaguucuccgagaucgagacgcgccugaacaugaucaacgacaagaucgacgaccagauccaggacaucugggccuauaacgccgagcugcucguccugcuggagaaccagaagacccucgacgagcacgacgccaacgugaacaaccuguacaacaaggugaagcgggcccugggcucgaacgcggucgaggacgggaagggcugcuucgaccucuaccacaagugcgauaaccagugcauggagaccauccgcaacggcaccuacaaccgccggaaguaccaggaggagucccgccuggagcggcagaagaucgagggggugaagcuggagucggagggcacguacaagauccucaccaucuacuccaccgucgccucgucccuggugaucgccaugggguucgccgccuuccuguucugggcgaugagcaacggcuccugccgcugcaacaucugcaucuga

SEQ ID NO: 10543 - RNA, 1683 nt, Artificial Sequence
  derived and/or modified CDS sequence (AUadapt) from InfluenzaA__AGQ81150__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacggaccuggggcgcccgcucauccuggacacguguaccaucgagggccugaucuacgggaaccccuccugcgaccucccccuggagggccgggaguggagcuacaucgucgagcgccccuccgccgugaacggcgugugcuacccggggaacgucgagaaccuggaggagcuccggucgcuguucuccucggccuccagcuaccagcgcauccagaucuuccccgauuccaucuggaacgugucguacuccggcaccucgaaggcgugcuccgacagcuucuaccgguccaugcgcuggcugacccagaagaacaacaacuaccccgugcaggacgcccaguacaccaacgaccgggggaauaacauccucuucauguggggcaucaaccacccgcccaccgacaccguccagacgaaccuguacacccgcaccgacaccacgaccucgguggccaccgaggacaucaaccggaccuucaagccccugaucgggccccgcccccucgugaacggccugcagggccggaucgacuacuacugggccguccugaagccggggcagacgcuccgcgugcgguccaacggcaaucugaucgcgcccugguacgggcacauccugcucggcgagucgcacggccgcauccugaagaccgaccucaagagcgggaacugcgugguccagugccagaccgagcggggcgggcugaacaccacgcugcccuuccacaacguguccaaguacgccuucggcaacugucccaaguacaucggggucaagucgcugaagcucgccgugggccugcgcaacgugccggcccgguccucgcgcggccuguucggggccaucgcgggcuucaucgagggcgggugguccgggcucguggccggcugguacggcuuccagcacagcaacgaccaggggaccggcauggccgccgaccgggacuccacccagaaggccaucgacaagaucaccucgaaggucaacaauaucguggacaagaugaacaagcaguacgacaucaucgaccacgaguucuccgagaucgagacgcgccugaacaugaucaacgacaagaucgacgaccagauccaggacaucugggcguacaacgccgagcugcucgugcugcuggagaaccagaagacccucgacgagcaugacgccaacgucaacaaccuguacaacaaggugaagcgggcccuggggucgaacgccgucgaggacggcaaggggugcuucgaccucuaccacaagugcgacaaccaguguauggagaccauccgcaacggcaccuacaaccgccggaaguaccaggaggagucccgccuggagcggcagaagaucgagggcgugaagcuggagagcgaggggacguacaagauccucaccaucuacuccaccguggcgucgucccuggucaucgccaugggcuucgccgccuuccuguucugggccaugagcaacggguccugccgcugcaacaucugcaucuga

SEQ ID NO: 10544 - RNA, 1683 nt, Artificial Sequence
  derived and/or modified CDS sequence (AUadapt) from InfluenzaA__AGQ81152__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggucguacaucgucgagcgccccuccgccgugaacggcgugugcuacccggggaacgucgagaaccuggaggagcuccggucgcuguuuuccucggccuccucguaccagaagauccagaucuuccccgacuccaucuggaacgugagcuacuccggcaccucgaaggcgugcuccgacucguucuaccgcuccaugcgguggcugacccagaagaacaacaacuaccccgugcaggacgcccaguacaccaacaaccgcgggaagaacauccucuucauguggggcaucaaccacccgcccaccgacaccguccagacgaaccuguacacccggaccgacaccacgaccucgguggccaccgaggauaucaaccgcaccuucaagccccugaucgggccccggccccucgugaacggccugcagggccgcaucgacuacuacugggccguccugaagccggggcagacgcuccgggugcgcuccaacggcaaccugaucgcgcccugguacgggcacauccugcucggcgagucgcacggccggauccugaagaccgaccucaagucggggaacugcgugguccagugccagaccgagcgcggcgggcugaacaccacgcugcccuuccacaacguguccaaguacgccuucggcaacugccccaaguacaucggggucaagucgcugaagcucgccgugggccugcggaacgugccggcccgcuccagccggggccuguucggggccaucgcgggcuucaucgagggcgggugguccgggcucguggccggcugguauggcuuccagcacucgaacgaccaggggaccggcauggccgccgaccgcgacuccacccagaaggccaucgacaagaucaccucgaaggucaacaacaucguggacaagaugaacaagcaguacgagaucaucgaccacgaguucuccgagaucgagacgcggcugaacaugaucaacgacaagaucgacgaccagauccaggacaucugggcguacaacgccgagcugcucgugcugcuggagaaccagaagacccucgacgagcacgacgccaacgucaacaaucuguacaacaaggugaagcgcgcccuggggucgaacgccgucgaggacggcaaggggugcuucgaccucuaccacaagugcgacaaccagugcauggagaccauccggaacggcaccuacaaccgccgcaaguaccaggaggagucccggcuggagcgccagaagaucgagggcgugaagcuggagucggaggggacguacaagauccucaccaucuacuccaccguggcgucgucccuggucaucgccaugggcuucgccgccuuccuguucugggccaugagcaacggguccugccggugcaacaucugcaucuga

SEQ ID NO: 10545 - RNA, 1683 nt, Artificial Sequence
  derived and/or modified CDS sequence (AUadapt) from InfluenzaA__AGQ81153__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggucguacaucgucgagcgccccuccgccgugaacggcgugugcuacccggggaacgucgagaaccuggaggagcuccggucgcuguucuccucggccuccucguaccagaagauccagaucuuccccgacuccaucuggaacgugucguauggcgggaucuccaaggcgugcucgaacuccuucuaccgcucgaugcgguggcugacccagaagaacaacaacuaccccgugcaggacgcccaguacaccaacaaccgcggcaagaacauccucuucaugugggggaucaaccacccgcccaccaacaccacccagacggaccuguacacccggaccgacaccacgaccuccgucgccaccgaggacauccaccgcaccuucaagccccugaucggcccccggccccucgugaacggccugcaggggcgcaucgacuacuacugggccgugcugaagccgggccagacgcuccggguccgcucgaacgggaaccugaucgcgcccugguacggccacauccugcucggcaagucccacgggcggauccugaagaccgaccucaagucgggcaacugcguggugcagugucagaccgagcgcgggggccugaacaccacgcugcccuuccacaacgucucgaaguacgccuucgggaacugccccaaguacaucggcgugaagucccugaagcucgccgugggccugcggaacgucccggcccgcucgucccgggggcuguucggcgccaucgcgggguucaucgagggcggguggucgggccucguggccggcugguacggguuccagcacuccaacgaccagggcaccgggauggccgccgaccgcgacucgacccagaaggccaucgacaagaucaccuccaaggugaacaacaucgucgacaagaugaacaagcaguacgagaucaucgaccacgaguucucggagaucgagacgcggcugaacaugaucaacgacaagaucgacgaccagauccaggacaucugggcguauaacgccgagcugcucgugcugcuggagaaccagaagacccucgacgagcacgacgccaacgugaacaaccuguacaacaaggucaagcgcgcccugggcuccaacgccguggaggacgggaagggcugcuucgaccucuaccacaagugcgacaaccagugcauggagaccauccggaacggcaccuacaaccgccgcaaguaccaggaggagucgcggcuggagcgccagaagaucgagggggucaagcuggaguccgagggcacguacaagauccucaccaucuacucgaccguggcguccucgcuggugaucgccaugggguucgccgccuuccuguucugggccauguccaacggcagcugccggugcaacaucugcaucuga

SEQ ID NO: 10546 - RNA, 1683 nt, Artificial Sequence
  derived and/or modified CDS sequence (AUadapt) from InfluenzaA__AGQ81155__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggucguacaucgucgagcgccccuccgccgugaacggcguguguuacccggggaacgucgagaaccuggaggagcuccggucgcuguucuccucggccuccucguaccagaagauccagaucuuccccgacuccaucuggaacgugucguacaacggcaccuccaaggcgugcucggacuccuucuaccgcucgaugcgguggcugacccagaagaacaacaacuaccccgugcaggacgcccaguacaccaauaaccgcgggaagaacauccucuucauguggggcaucaaccacccgcccaccgacaccacgcagaccaaccuguacacccggaccgacacgaccaccuccgucgccaccgaggacaucaaccgcacguucaagccccugaucgggccccggccccucgugaacggccugcagggccgcaucgacuacuacugggccgugcugaagccggggcagacccuccggguccgcagcaacggcaaccugaucgcgcccugguacgggcacauccugcucggcgagucccacggccggauccugaagaccgaccucaagucggggaacugcguggugcagugucagaccgagcgcggcgggcugaacacgacccugcccuuccacaacgucucgaaguacgccuucggcgacugccccaaguacaucggggugaagucccugaagcucgccgugggccugcggaacgucccggcccgcucgucccggggccuguucggggccaucgcgggcuucaucgagggcggguggucggggcucguggccggcugguacggcuuccagcacuccaacgaccaggggaccggcauggccgccgaccgcgacucgacccagaaggccaucgacaagaucacguccaaggugaacaauaucgucgacaagaugaacaagcaguacgagaucaucgaccacgaguucucggagaucgagacccggcugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgcgcccugggguccaacgccguggaggacggcaagggguguuucgaccucuaccacaagugcgacaaccagugcauggagaccauccggaacggcacguacaaccgccgcaaguaccaggaggagucgcggcuggagcgccaggagaucgagggcgucaagcuggaguccgaggggaccuacaagauccucaccaucuacucgaccguggcguccucgcuggugaucgccaugggcuucgccgccuuccuguucugggccauguccaacgggagcugccggugcaacaucugcaucuga

SEQ ID NO: 10547 - RNA, 1683 nt, Artificial Sequence
  derived and/or modified CDS sequence (AUadapt) from InfluenzaA__AGQ81156__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggucguacaucgucgagcgccccuccgccgugaacggcgugugcuacccggggaacgucgagaaccuggaggagcuccggucgcuguuuuccucggccuccucguaccagaagauccagaucuuccccgacuccaucuggaacgugucguacggcgggaucuccaaggcgugcucgaacuccuucuaccgcucgaugcgguggcugacccagaagaacaacaacuaccccgugcaggacgcccaguacaccaacaaccgcggcaagaacauccucuucaugugggggaucaaccacccgcccaccaacaccacccagacggaccuguacacccggaccgacaccacgaccuccgucgccaccgaggacauccaucgcaccuucaagccccugaucggcccccggccccucgugaacggccugcaggggcgcaucgacuacuacugggccgugcugaagccgggccagacgcuccggguccgcagcaacgggaaccugaucgcgcccugguacggccacauccugcucggcgagucccacgggcggauccugaagaccgaccucaagucgggcaacugcguggugcagugccagaccgagcgcgggggccugaacaccacgcugcccuuccacaacgucucgaaguacgccuucgggaacugccccaaguacaucggcgugaagucccugaagcucgccgugggccugcggaacgucccggcccgcucgucccgggggcuguucggcgccaucgcgggguucaucgagggcggguggucgggccucguggccggcugguauggguuccagcacuccaacgaccagggcaccgggauggccgccgaccgcgacucgacccagaaggccaucgacaagaucaccuccaaggugaacaacaucgucgacaagaugaacaagcaguacgagaucaucgaccacgaguucucggagaucgagacgcggcugaacaugaucaacgacaagaucgacgaccagauccaggacaucugggcguacaacgccgagcugcucgugcugcuggagaaccagaagacccucgacgagcacgacgccaacgugaacaaucuguacaacaaggucaagcgcgcccugggcuccaacgccguggaggacgggaagggcugcuucgaccucuaccacaagugcgacaaccagugcauggagaccauccggaacggcaccuacaaccgccgcaaguaccaggaggagucgcggcuggagcgccagaagaucgagggggucaagcuggaguccgagggcacguacaagauccucaccaucuacucgaccguggcguccucgcuggugaucgccaugggguucgccgccuuccuguucugggccauguccaacggcagcugccggugcaacaucugcaucuga

SEQ ID NO: 10548 - RNA, 1683 nt, Artificial Sequence
  derived and/or modified CDS sequence (AUadapt) from InfluenzaA__AGQ81157__HA
auggaggccgccaccaucaucaccauccugcucgugaucacgggcaauaacgcggacaagaucugcaucggguaccagucgaccaacuccaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccucgugcgaccucccccuggagggccgggacugguccuacaucgucgagcgccccucggccgugaacggcgugugcuacccggggaacgucgagaaccuggaggagcuccggucccuguucaguuccgccucguccuaccagaagauccagaucuuccccgacucgaucuggaacguguccuacaacggcaccucgaaggcgugcuccgacucguucuaccgcuccaugcgguggcugacccagaagaacaacaacuaccccgugcaggacgcccaguacaccaacaaccgcgggaagaacauccucuucauguggggcaucaaccacccgcccaccgacaccacgcagaccaaccuguacacccggaccgacacgaccaccucggucgccaccgaggauaucaaccgcacguucaagccccugaucgggccccggccccucgugaacggccugcagggccgcaucgacuacuacugggccgugcugaagccggggcagacccuccggguccgcuccaacggcaaccugaucgcgcccugguacgggcacauccugcucggcgagucgcacggccggauccugaagaccgaccugaaguccgggaacugcguggugcagugccagaccgagcgcggcgggcucaacacgacccugcccuuccacaacgucucgaaguacgccuucggcgacugccccaaguacaucggggucaagucgcugaagcucgccgugggccugcggaacgugccggcccgcuccucgcggggccuguucggggccaucgcgggcuucaucgagggcgggugguccgggcucguggccggcugguauggcuuccagcacucgaacgaccaggggaccggcauggccgccgaccgcgacuccacccagaaggccaucgacaagaucacgucgaaggugaacaacaucgucgacaagaugaacaagcaguacgagaucaucgaccacgaguucuccgagaucgagacccggcugaacaugaucaacgacaagaucgacgaccagauccaggacaucugggcguacaacgccgagcugcucgugcugcuggagaaccagaagacccucgacgagcacgacgccaacgugaacaaucuguacaacaaggucaagcgcgcccuggggucgaacgccguggaggacggcaaggggugcuucgaccucuaccacaagugcgacaaccagugcauggagaccauccggaacggcacguacaaccgccgcaaguaccaggaggagucccggcuggagcgccagaagaucgagggcgucaagcuggagucggaggggaccuacaagauccucaccaucuacuccaccguggcgucgucccuggugaucgccaugggcuucgccgccuuccuguucugggccaugucgaacggguccugccggugcaacaucugcaucuga

SEQ ID NO: 10549 - RNA, 1683 nt, Artificial Sequence
  derived and/or modified CDS sequence (AUadapt) from InfluenzaA__AGQ81158__HA
auggagguggucaccaucaucaccauccugcucgugaucacgcgcaguaacgccgacaagaucugcaucggcuaccaguccaccaacucgaccgagaccguggacacgcugaccgagaacaacguccccgugacccacgccaaggagcugcuccacaccgagcacaacgggaugcugugcgcgacgaaccugggccggccgcucauccuggacacgugcaccaucgaggggcugaucuacggcaaccccuccugcgaccucccccuggaggggcgcgaguggagcuacaucguggagcggcccuccgccgucaacggcgugugcuauccgggcaacguggagaaccuggaggagcuccgcucgcuguucuccucggccuccagcuaccagcggauccagaucuuccccgacuccaucuggaacgucucguacuccgggaccucgaaggccugcuccgacagcuucuaccgcuccaugcgguggcugacccagaagaacaacaacuaccccgugcaggacgcccaguacaccaacaaucgcggcaagaacauccucuucaugugggggaucaaccacccgcccaccgacaccgcgcagacgaaccuguacacccggaccgacaccacgaccucgguggccaccgaggacaucaaccgcaccuucaagccccugaucggcccccggccccucgucaacgggcugcagggccgcaucgacuacuacugggccgugcugaagccgggccagacgcuccgggugcgcuccaacgggaaccugaucgcccccugguacggccacauccugcucggggagucgcacggccggauccugaagaccgaccucaagagcggcuccugcgucgugcagugccagaccgagcgcgggggccugaauaccacgcugcccuuccacaacgugucgaaguacgcguucgggaacugccccaaguacaucggcgucaagucccugaagcucgccguggggcugcggaacgugccggcccgcucgucccggggccuguucggcgccaucgccggguucaucgagggcggguggagcggccucgucgcggggugguacggcuuccagcacuccaacgaccagggcaccgggauggccgccgaccgcgacucgacccagaaggccaucgacaagaucaccuccaaggugaacaacaucguggauaagaugaacaagcaguacgagaucaucaaccacgaguucucggagaucgagacgcggcugaacaugaucaacgacaagaucgacgaccagauccaggacaucugggccuacaacgcggagcugcucguccugcuggagaaccagaagacccucgacgagcacgacgccaacgugaacaaccuguacaacaaggucaagcgcgcccugggcuccaacgccguggaggacgggaagggcuguuucgaccucuaccacaagugcgacaaccagugcauggagaccauccgcaacgggaccuacaaccggcgcauguaccaggaggagagccggcuggagcgccagaagaucgagggcgugaagcuggaguccgagggcacguacaagauccucaccaucuacucgaccgucgccuccucgcuggugaucgcgaugggguucgccgccuuccuguucugggccauguccaacggcagcugccggugcaacaucugcaucuga

SEQ ID NO: 10550 - RNA, 1683 nt, Artificial Sequence
  derived and/or modified CDS sequence (AUadapt) from InfluenzaA__AGQ81159__HA
auggaggccgccaccaucaucaccauccugcucgugaucacgggcaguaacgcggacaagaucugcaucggguaccaguccaccaacucgaccgagaccgucgacacgcugaccgagaacaacgugcccgugacccacgccaaggagcugcuccacaccgagcacaacggcaugcugugcgccacgaaccuggggcgcccgcucauccuggacacgugcaccaucgagggccugaucuacgggaaccccuccugcgaccucccccuggagggccgggacuggucguacaucgucgagcgccccuccgccgugaacggcgugugcuacccggggaacgucgagaaccuggaggagcuccggucgcuguucuccucggccuccucguaccagaagauccagaucuuccccgacuccaucuggaacgugucguacgacggcaucuccaaggcgugcucgaacuccuucuaccgcucgaugcgguggcugaccaagaagaacaacuccuaccccgugcaggacgcccaguacaccaacaauaucgggaagaacauccucuucauguggggcaucaaccacccgcccaccaacaccacccagacggaccuguacacccgcaccgacaccacgaccagcgucgccaccgaggacauccaccggaccuucaagccccugaucgggccccggcccccggugaacggccuccugggccgcaucgacuacuacugggccgugcugaagcccgggcagacgcuccgcguccgguccaacggcaaccugaucgcgcccugguacgggcacauccugcucggcgagucgcacggccgcauccugaagaccgaccucaagucggggaacugcguggugcagugccagaccgagcggggcgggcugaacaccacgcugcccuuccacaacgucuccaaguacgccuucggcaacugcccgaaguacaucggggucaagucgcugaagcucgccgugggccugcgcaacgugcccgcccgguccucgcgcggccuguucggggccaucgcgggcuucaucgagggcgggugguccgggcucguggccggcugguacggcuuccagcacucgaacgaccaggggaccggcauggccgccgaccgggacuccacccagaaggccaucgacaagaucaccucgaaggugaacaauaucgucgacaagaugaacaagcaguacgagaucaucgaccacgaguucuccgagaucgagacgcgccugaacaugaucaacgacaagaucgacgaccagauccaggacaucugggcguacaacgccgagcugcucgugcugcuggagaaccagaagacccucgacgagcacgacgccaacgugaacaaccuguacaacaaggucaagcgggcccuggggucgaacgccguggaggacggcaaggggugcuucgaccucuaccacaagugcgacaaccagugcauggagaccauccgcaacggcaccuacaaccggcgcaaguaccaggaggagucccgccuggagcggcagaagaucgagggcgucaagcuggagucggaggggacguacaagauccucaccaucuacuccaccguggcgucgucccuggugaucgccaugggcuucgccgccuuccuguucugggccaugagcaacggguccugccgcugcaacaucugcaucuga

SEQ ID NO: 10551 - RNA, 1683 nt, Artificial Sequence
  derived and/or modified CDS sequence (AUadapt) from InfluenzaA__AGQ81161__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgacccccugcuggaggggcgcgaguggucguacaucguggagcggcccuccgccgucaacggccucugcuacccgggcaacguggagaaccuggaggagcugcgcucgcucuucuccucggcccgguccuaccagcgcauccagaucuuccccgacaccaucuggaacgugucguacgacgggaccuccaaggccugcucgggcuccuucuaccggaacaugcgcuggcugacccagaagaacucggacuaccccauccaggacgcgcaguacaccaacaaccaggggaagaacauccuguucauguggggcaucaaccacccgcccaccgacacgacccagcgggaccucuacacccgcaccgacacgaccaccuccgucgccaccgaggagaucaaccggaucuucaagccccugaucgggccccgcccccuggugaacggccucaugggccggaucgacuacuacuggucggugcugaagccggggcagacgcugcgcaucaaguccgacggcaaccucaucgcccccugguacgggcacauccugagcggcgagucgcacggccggauccugaagaccgaccucaagaagggguccugcaccguccagugccagaccgagaagggcgggcugaacacgacccugcccuuccagaacgugucgaaguacgccuucggcaacugcuccaaguacaucgggaucaagucgcucaagcuggcggugggccugcgcaacguccccucccggucgucccgcggccucuucggggccaucgccggcuucaucgagggcggguggucggggcugguggccggcugguacggcuuccagcacuccaacgaccagggggugggcauggccgcggaccgggacucgacccagaaggccaucgacaagaucaccuccaaggucaacaacaucguggacaagaugaacaagcaguacgagaucaucgaccacgaguucucggagguggagacgcgccugaacaugaucaacaacaagaucgacgaccagauccaggacaucugggccuacaacgccgagcuccugguccugcucgagaaccagaagacccuggacgagcacgacgccaacgugaacaaccuguacaacaaggugaagcgggcgcucggguccaacgccgucgaggacggcaaggggugcuucgagcuguaccacaagugcgacgaccagugcauggagaccauccgcaacggcaccuacaaccggcgcaaguaccaggaggagucgaagcuggagcgccagaagaucgagggcgugaagcucgaguccgaggggacguacaagauccugaccaucuacucgaccgucgccuccucgcuggugaucgccaugggcuucgccgcguuccucuucugggccauguccaacgggagcugccggugcaacaucugcaucuga

SEQ ID NO: 10552 - RNA, 1683 nt, Artificial Sequence
  derived and/or modified CDS sequence (AUadapt) from InfluenzaA__AGQ81162__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcucgcuguucuccagcgcccgguccuaccagcgcauccagaucuucccggacaccaucuggaacgugucguacgacgggaccuccaaggccugcucgggcuccuucuaccggucgaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccucggucgccaccgaggagaucaaccggaucuucaagccccugaucgggccccgcccccucgugaacggccugaugggccggaucgacuacuacugguccgugcugaagcccgggcagacgcuccgcaucaagucggacggcaaccugaucgccccgugguacgggcacauccugagcggcgagucccacggccggauccucaagaccgaccugaagaaggggucgugcaccguccagugccagaccgagaagggcgggcugaacacgacccuccccuuccagaacguguccaaguacgccuucggcaacugcucgaaguacaucgggaucaagucccugaagcuggcggugggccuccgcaacguccccucgcgguccucgcgcggccuguucggggccaucgccggcuucaucgagggcgggugguccgggcugguggccggcugguacggcuuccagcacucgaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggucgaacgccgucgaggacggcaaggggugcuucgagcuguaccacaagugcgacgaccagugcauggagaccauccgcaacggcaccuacaaccggaagaaguaccaggaggaguccaagcucgagcgccagaagaucgagggcgugaagcuggagucggaggggacguacaagauccugaccaucuacuccaccgucgccucgucccucgugaucgccaugggcuucgccgcguuccuguucugggccaugucgaacgggagcugccgcugcaacaucugcaucuga

SEQ ID NO: 10553 - RNA, 1683 nt, Artificial Sequence
  derived and/or modified CDS sequence (AUadapt) from InfluenzaA__AGQ81164__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcucgcuguucuccagcgcccgguccuaccagcgcauccagaucuucccggacaccaucuggaacgugucguacgacgggaccuccaaggccugcucgggcuccuucuaccggucgaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccucggucgccaccgaggagaucaaccggaucuucaagccccugaucgggccccgcccccucgugaacggccugaugggccggaucgacuacuacugguccgugcugaagcccgggcagacgcuccgcaucaagucggacggcaaccugaucgccccgugguacgggcacauccugagcggcgagucccacggccggauccucaagaccgaccugaagaaggggucgugcaccguccagugccagaccgagaagggcgggcugaacacgacccuccccuuccagaacguguccaaguacgccuucggcaacugcucgaaguacaucgggaucaagucccugaagcuggcggugggccuccgcaacguccccucgcgguccucgcgcggccuguucggggccaucgccggcuucaucgagggcgggugguccgggcugguggccggcugguacggcuuccagcacucgaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggucgaacgccgucgaggacggcaaggggugcuucgagcuguaccacaagugcgacgaccagugcauggagaccauccgcaacggcaccuacaaccggcgcaaguaccaggaggaguccaagcucgagcgccagaagaucgagggcgugaagcuggagucggaggggacguacaagauccugaccaucuacuccaccgucgccucgucccucgugaucgccaugggcuucgccgcguuccuguucugggccaugucgaacgggagcugccggugcaacaucugcaucuga

SEQ ID NO: 10554 - RNA, 1683 nt, Artificial Sequence
  derived and/or modified CDS sequence (AUadapt) from InfluenzaA__AGQ81167__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcucgcuguucuccagcgcccgguccuaccagcgcauccagaucuucccggacaccaucuggaacgugucguacaacgggaccuccaaggccugcucgggcuccuucuaccggucgaugcgcuggcugacccagaagaacuccaacuaccccauccaggacgcgcaguacaccaacaaccaggggaagaacauccucuucauguggggcaucaaccacccgcccaccgacacgacccagcgggaccuguacacccgcaccgacacgaccaccucggucgccaccgaggagaucaaccggaucuucaagccccugaucgggccccgcccccucgugaacggccugaugggccggaucgacuacuacugguccgugcugaagcccgggcagacgcuccgcaucaagucggacggcaaccugaucgccccgugguacgggcacauccugagcggcgagucccacggccggauccucaagaccgaccugaagaaggggucgugcaccguccagugccagaccgagaagggcgggcugaacacgacccuccccuuccagaacguguccaaguacgccuucggcaacugcucgaaguacaucgggaucaagucccugaagcuggcggugggccuccgcaacguccccucgcgguccucgcgcggccuguucggggccaucgccggcuucaucgagggcgggugguccgggcugguggccggcugguacggcuuccagcacucgaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggucgaacgccgucgaggacggcaaggggugcuucgagcuguaccacaagugcgacgaccagugcauggagaccauccgcaacggcaccuacaaccggcgcaaguaccaggaggaguccaagcucgagcgccagaagaucgagggcgugaagcuggagucggaggggacguacaagauccugaccaucuacuccaccgucgccucgucccucgugaucgccaugggcuucgccgcguuccuguucugggccaugucgaacgggagcugccggugcaacaucugcaucuga

SEQ ID NO: 10555 - RNA, 1683 nt, Artificial Sequence
  derived and/or modified CDS sequence (AUadapt) from InfluenzaA__AGQ81168__HA
auggagaccgugagucugaucaccauccuccuggucgugacgguguccaacgccgacaagaucugcaucggcuaccagucgaccaacuccaccgagaccgucgacacgcugaccgagaacaacgugcccgugacccacgcccgcgagcuccugcacaccgagcacaacgggaugcugugcgcgacgucgcucggccacccgcugauccuggacacgugcaccaucgaggggcucaucuacggcaaccccuccugcgaccugcugcucgggggccgggaguggagcuacaucgucgagcgccccuccgccgugaacggccugugcuaccccgggaacguggagaaccuggaggagcuccggucgcuguucuccucggcccgcuccuaccagcggauccagaucuucccggacaccaucuggaacgucucguacuccggcaccagcaaggccugcuccgacucguucuaccgcuccaugcgguggcugacccagaaggggaacgccuaccccauccaggacgcgcaguacaccaacaaccagggcaagaacauccucuucaugugggggaucaaccacccgcccaccgacacggcccagaccaaccuguacacccgcaccgacacgaccaccucgguggccaccgaggagaucaaccggacguucaagccccugaucggcccccgcccccucgugaacggccugauggggcggaucaacuacuacugguccguccugaagcccggccagacccuccgcaucaagucgaacgggaaccugaucgccccgugguacggccacauccugagcggcgagucccacgggcggauccucaagaccgaccugaagcgcggcucgugcaccgugcagugccagacggagaagggcgggcugaauaccacccuccccuuccagaacguguccaaguacgcguucgggaacugcucgaaguacaucggcaugaagucccugaagcuggccgucggccuccggaacgugcccucgcgcuccagccgggggcuguucggcgccaucgccggguucaucgagggcgggugguccggccugguggccggcugguacggguuccagcacucgaacgaccagggcgucgggauggcggccgaccgcgacuccacccagaaggccaucgacaagaucacgucgaaggugaacaacaucguggacaagaugaacaagcaguacgagaucaucgaccacgaguucuccgaggucgagacccggcucaacaugaucaacaacaagaucgacgaccagauccaggacaucugggccuacaacgccgagcugcuggugcuccuggagaaccagaagacccuggacgagcacgacgcgaacgugaacaaccucuacaacaaggucaagcgcgcccugggcucgaacgccguggaggacgggaagggcugcuucgagcuguaccacaagugcgacgaccagugcauggagaccauccggaacggcacguacaaccgccgcaaguaccaggaggaguccaagcucgagcggcagaagaucgagggggucaagcuggagagcgagggcaccuacaagauccugaccaucuacuccaccguggccucgucccucgugaucgccaugggguucgcggccuuccuguucugggccaugucgaacggcagcugccgcugcaacaucugcaucuga

SEQ ID NO: 10556 - RNA, 1683 nt, Artificial Sequence
  derived and/or modified CDS sequence (AUadapt) from InfluenzaA__AGQ81169__HA
auggagaccgugucgcugaucaccauccuccuggucgugacgguguccaacgccgacaagaucugcaucggcuaccagucgaccaacuccaccgagaccgucgacacgcugaccgagaacaacgugcccgugacccacgcccgcgagcuccugcacaccgagcacaacgggaugcugugcgcgacgucgcucggccacccgcugauccuggacacgugcaccaucgaggggcucaucuacggcaaccccuccugcgaccugcugcucgggggccgggaguggucguacaucgucgagcgccccuccgccgugaacggccugugcuaccccgggaacguggagaaccuggaggagcuccggagccuguucuccucggcccgcuccuaccagcggauccagaucuucccggacaccaucuggaacgucucguacuccggcaccucgaaggccugcuccgacucguucuaccgcuccaugcgguggcugacccagaaggacaacgccuaccccauccaggacgcgcaguacaccaacaaccaggagaagaacauccucuucaugugggggaucaaccacccgcccaccgacacggugcagaccaaccuguacacccgcaccgacacgaccaccagcguggccaccgaggagaucaaccggacguucaagccccugaucggcccccgcccccucgucaacgggcugaugggccggaucaacuacuacugguccgugcugaagcccggccagacccuccgcaucaagucgaacgggaaccugaucgccccgugguacggccacauccugucgggggagucccacggccggauccucaagaccgaccugaagcgcggcucgugcaccgugcagugccagacggagaagggcgggcugaacaccacccuccccuuccagaacgucuccaaguacgccuucgggaacugcagcaaguacaucggcaugaagucccugaagcuggcgguggggcuccggaacgugcccucgcgcuccucgcggggccuguucggcgccaucgccggguucaucgagggcgggugguccggccuggucgccgggugguacggcuuccagcacucgaacgaccagggcguggggauggccgcggaccgcgacuccacccagaaggccaucgacaagaucacgucgaaggugaacaacaucgucgacaagaugaacaagcaguacgagaucaucgaccacgaguucuccgagguggagacccggcucaacaugaucaacaacaagaucgacgaccagauccaggacaucugggccuacaacgccgagcugcuggugcuccuggagaaccagaagacccuggacgagcacgacgccaacgucaacaaccucuacaacaaggugaagcgcgcgcugggcagcaacgccgucgaggacgggaagggcugcuucgagcuguaccacaagugcgacgaccagugcauggagaccauccggaacgggacguacaaccgccgcaaguaccaggaggaguccaagcucgagcggcagaagaucgagggcgugaagcuggagucggagggcaccuacaagauccugaccaucuacuccaccguggccucgucccucgucaucgccaugggguucgccgcguuccuguucugggccaugucgaacggcagcugccgcugcaacaucugcaucuga

SEQ ID NO: 10557 - RNA, 1683 nt, Artificial Sequence
  derived and/or modified CDS sequence (AUadapt) from InfluenzaA__AGQ81170__HA
auggagaccgugagucugaucaccauccuccuggucgugacgguguccaacgccgacaagaucugcaucggcuaccagucgaccaacuccaccgagaccgucgacacgcugaccgagaacaacgugcccgugacccacgcccgcgagcuccugcacaccgagcacaacgggaugcugugcgcgacgucgcucggccacccgcugauccuggacacgugcaccaucgaggggcucaucuacggcaaccccuccugcgaccugcugcucgggggccgggaguggucguacaucgucgagcgccccuccgccgugaacggccugugcuaccccgggaacguggagaaccuggaggagcuccggagccuguucuccucggcccgcuccuaccagcggauccagaucuucccggacaccaucuggaacgucucguacuccggcaccucgaaggccugcuccgacucguucuaccgcuccaugcgguggcugacccagaaggacaacgccuaccccauccaggacgcgcaguacaccaacaaccaggggaagaacauccucuucauguggggcaucaaccacccgcccaccgacacggcccagaccaaccuguacacccgcaccgacacgaccaccagcguggccaccgaggagaucaaccggacguucaagccccugaucgggccccgcccccucgugaacggccugaugggccggaucaacuacuacugguccguccugaagcccgggcagacccuccgcaucaagucgaacggcaaccugaucgccccgugguacgggcacauccugucgggcgagucccacggccggauccucaagaccgaccugaagcgcgggucgugcaccgugcagugccagacggagaagggcgggcugaacaccacccuccccuuccagaacguguccaaguacgcguucggcaacugcagcaaguacaucgggaugaagucccugaagcuggccgucggccuccggaacgugcccucgcgcuccucgcggggccuguucggggccaucgccggcuucaucgagggcgggugguccgggcugguggccggcugguacggcuuccagcacucgaacgaccagggggucggcauggcggccgaccgcgacuccacccagaaggccaucgacaagaucacgucgaaggugaacaacaucguggacaagaugaacaagcaguacgagaucaucgaccacgaguucuccgaggucgagacccggcucaacaugaucaacaacaagaucgacgaccagauccaggacaucugggccuacaacgccgagcugcuggugcuccuggagaaccagaagacccuggacgagcacgacgcgaacgugaacaaccucuacaacaaggucaagcgcgcccuggggagcaacgccguggaggacggcaaggggugcuucgagcuguaccacaagugcgacgaccagugcauggagaccauccggaacggcacguacaaccgccgcaaguaccaggaggaguccaagcucgagcggcagaagaucgagggcgucaagcuggagucggaggggaccuacaagauccugaccaucuacuccaccguggccucgucccucgugaucgccaugggcuucgcggccuuccuguucugggccaugucgaacgggagcugccgcugcaacaucugcaucuga

SEQ ID NO: 10558 - RNA, 1683 nt, Artificial Sequence; identical to SEQ ID NO: 10557
  derived and/or modified CDS sequence (AUadapt) from InfluenzaA__AGQ81171__HA

SEQ ID NO: 10559 - RNA, 1683 nt, Artificial Sequence; identical to SEQ ID NO: 10557
  derived and/or modified CDS sequence (AUadapt) from InfluenzaA__AGQ81172__HA

SEQ ID NO: 10560 - RNA, 1683 nt, Artificial Sequence
  derived and/or modified CDS sequence (AUadapt) from InfluenzaA__AGQ81173__HA
auggagaccgccucgcugaucaccauccuccugguggucacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggcaacccgcugauccuggacacgugcaccaucgaggggcucaucuacggcaaccccuccugcgaccugcugcucgggggccgcgaguggucguacaucguggagcggcccuccgccgucaacggccugugcuaccccgggaacguggagaaccuggaggagcuccgcucgcuguucuccucggcccgguccuaccagcgcauccagaucuucccggacaccaucuggaacgugucguacuccggcaccagcaaggccugcuccgacucguucuaccgguccaugcgcuggcugacccagaaggacaacgcguaccccauccaggacgcccaguacaccaacaaccaggggaagaacauccucuucauguggggcaucaaccacccgcccaccgacacggcccagaccaaccuguacacccggaccgacacgaccaccucggucgccaccgaggagaucaaccgcacguucaagccccugaucgggccccggccccucgugaacggccugaugggccgcaucaacuacuacugguccgugcugaagcccgggcagacccuccggaucaagucgaacggcaaccugaucgcgccgugguacgggcacauccugucgggcgagucccacggccgcauccucaagaccgaccugaagcgggggucgugcaccguccagugccagacggagaagggcgggcugaacaccacccuccccuuccagaacguguccaaguacgccuucggcaacugcucgaaguacaucgggaugaagucccugaagcuggccgugggccuccgcaacguccccucgcgguccagccgcggccuguucggggccaucgccggcuucaucgagggcgggugguccgggcugguggcgggcugguacggcuuccagcacucgaacgaccagggggugggcauggccgccgaccgggacuccacccagaaggccaucgacaagaucacgucgaaggucaacaacaucguggacaagaugaacaagcaguacgagaucaucgaccacgaguucuccgagguggagacccgccucaacaugaucaacaacaagaucgacgaccagauccaggacaucugggccuacaacgcggagcugcugguccuccuggagaaccagaagacccuggacgagcacgacgccaacgugaacaaccucuacaacaaggugaagcgggcccuggggucgaacgccgucgaggacggcaaggggugcuucgagcuguaccacaagugcgacgaccagugcauggagaccauccgcaacggcacguacaaccggcgcaaguaccaggaggaguccaagcucgagcgccagaagaucgagggcgugaagcuggagucggaggggaccuacaagauccugaccaucuacuccaccgucgccucgucccucgugaucgcgaugggcuucgccgccuuccuguucugggccaugucgaacgggagcugccggugcaacaucugcaucuga

SEQ ID NO: 10561 - RNA, 1683 nt, Artificial Sequence; identical to SEQ ID NO: 10557
  derived and/or modified CDS sequence (AUadapt) from InfluenzaA__AGQ81175__HA

SEQ ID NO: 10562 - RNA, 1683 nt, Artificial Sequence
  derived and/or modified CDS sequence (AUadapt) from InfluenzaA__AGQ81177__HA
auggagaccgugagucugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcagccuguucuccucggcccgguccuaccagcgcauccagaucuucccggacaccaucuggaacgugucguacaacgggaccuccaaggccugcucgggcuccuucuaccggagcaugcgcuggcugacccggaagaacggggacuaccccauccaggacgcgcaguacaccaacaaccagggcaagaacauccucuucaugugggggaucaaccacccgcccaccgacacgacccagcgcgaccuguacacccggaccgacacgaccaccuccgucgccaccgaggagaucaaccgcaucuucaagccccugaucggcccccggccccucgugaacggccugauggggcgcaucgacuacuacuggucggugcugaagcccggccagacgcuccggaucaaguccgacgggaaccugaucgccccgugguacggccacauccugucgggcgagucgcacgggcgcauccucaagaccgaccugaagcggggcuccugcaccguccagugccagaccgagaagggcgggcugaacacgacccuccccuuucagaacgugucgaaguacgccuucgggaacugcuccaaguacaucggcaucaagagccugaagcuggcggugggccuccgcaacguccccucccggucgucccgcgggcuguucggcgccaucgccggguucaucgagggcggguggucgggccugguggccggcugguacggguuccagcacuccaacgaccagggcguggggauggccgcggaccgggacucgacccagaaggccaucgacaagaucaccuccaaggucaacaacaucguggacaagaugaacaagcaguacgagaucaucgaccacgaguucagcgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcugggcuccaacgccgucgaggacgggaagggcugcuucgagcuguaccacaagugcgacgaccagugcauggagaccauccgcaacggcaccuacaaccgccggaaguaccaggaggagucgaagcucgagcgccagaagaucgagggggugaagcuggaguccgagggcacguacaagauccugaccaucuacucgaccgucgccuccucgcucgugaucgccaugggguucgccgcguuccuguucugggccauguccaacggcagcugccggugcaacaucugcaucuga

SEQ ID NO: 10563 - RNA, 1683 nt, Artificial Sequence; identical to SEQ ID NO: 10562
  derived and/or modified CDS sequence (AUadapt) from InfluenzaA__AGQ81178__HA

SEQ ID NO: 10564 - RNA, 1683 nt, Artificial Sequence; identical to SEQ ID NO: 10554
  derived and/or modified CDS sequence (AUadapt) from InfluenzaA__AGQ81181__HA

SEQ ID NO: 10565 - RNA, 1683 nt, Artificial Sequence; identical to SEQ ID NO: 10554
  derived and/or modified CDS sequence (AUadapt) from InfluenzaA__AGQ81183__HA

SEQ ID NO: 10566 - RNA, 1683 nt, Artificial Sequence; identical to SEQ ID NO: 10553
  derived and/or modified CDS sequence (AUadapt) from InfluenzaA__AGQ81184__HA

SEQ ID NO: 10567 - RNA, 1683 nt, Artificial Sequence
  derived and/or modified CDS sequence (AUadapt) from InfluenzaA__AGQ81185__HA
auggagaccgccucgcugaucaccauccuccugguggccacggucuccaacgcggacaagaucugcaucggcuaccagucgaccaacuccaccgagaccguggacacgcugaccgagaacaacgugcccgucacccacgccaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgugaacggccugugcuaccccggcaacgucgagaaccuggaggagcuccgcucgcuguucuccucggcccgguccuaccagcgcauccagaucuucccggacaccaccuggaacgugucguacaacgggaccuccaaggcgugcucgggcuccuucuaccggucgaugcgcuggcugacccagaagaacuccaacuaccccauccaggacgcccaguacaccaacaaccaggggaagaacauccucuucauguggggcaucaaccacccgcccacggacaccacccagcgggaccuguacacccgcacggacaccaccaccucgguggccacggaggagaucaaccggaucuucaagccccugaucgggccccgcccccucgucaacggccugaugggccggaucgacuacuacugguccgugcugaagcccgggcagacccuccgcaucaagucggacggcaaccugaucgccccgugguacgggcacauccugagcggcgagucccacggccggauccucaagaccgaccugaagcgcgggucgugcaccgugcagugccagacggagaagggcgggcugaacaccacccuccccuuccagaacgucuccaaguacgcguucggcaacugcucgaaguacaucgggaucaagucccugaagcuggccgugggccuccggaacgugcccucgcgcuccucgcggggccuguucggggccaucgccggcuucaucgagggcgggugguccgggcuggucgccggcugguacggcuuccagcacucgaacgaccagggggugggcauggcggccgaccgcgacuccacccagaaggccaucgacaagaucacgucgaaggugaacaacaucgucgacaagaugaacaagcaguacgagaucaucgaccacgaguucuccgagguggagacccggcucaacaugaucaacaacaagaucgacgaccagauccaggacaucugggccuacaacgccgagcugcuggugcuccuggagaaccagaagacccuggacgagcacgacgcgaacgucaacaaccucuacaacaaggugaagcgcgcccuggggucgaacgccguggaggacggcaaggggugcuucgagcuguaccacaagugcgacaaccagugcauggagaccauccggaacggcacguacaaccgccgcaaguaccaggaggaguccaagcucgagcggcagaagaucgagggcgucaagcuggagucggaggggaccuacaagauccugaccaucuacuccaccguggccucgucccucgucaucgccaugggcuucgcggccuuccuguucugggccaugucgaacgggagcugccgcugcaacaucugcaucuga

SEQ ID NO: 10568 - RNA, 1683 nt, Artificial Sequence
  derived and/or modified CDS sequence (AUadapt) from InfluenzaA__AGQ81186__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcucgcuguucuccagcgcccgguccuaccagcgcauccagaucuucccggacaccaucuggaacgugucguacgacgggaccuccaaggccugcucgggcuccuucuaccggucgaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccucggucgccaccgaggagaucaaccggaucuucaagccccugaucgggccccgcccccucgugaacggccugaugggccggaucgacuacuacugguccgugcugaagcccgggcagacgcuccgcaucaagucggacggcaaccugaucgccccgugguacgggcacauccugagcggcgagucccacggccggauccucaagaccgaccugaagaaggggucgugcaccguccagugccagaccgagaagggcgggcugaacacgacccuccccuuccagaacguguccaaguacgccuucggcaacugcucgaaguacaucgggaucaagucccugaagcuggcgaucggccuccgcaacgugcccucgcgguccucgcgcggccuguucggggccaucgccggcuucaucgagggcgggugguccgggcuggucgccggcugguacggcuuccagcacucgaacgaccagggggugggcauggccgcggaccgggacuccacccagaaggccaucgacaagaucaccagcaaggugaacaacaucgucgacaagaugaacaagcaguacgagaucaucgaccacgaguucuccgagguggagacgcgccucaacaugaucaacaacaagaucgacgaccagauccaggacaucugggccuacaacgccgagcugcuggugcuccuggagaaccagaagacccuggacgagcacgacgccaacgucaacaaccucuacaacaaggugaagcgggcgcuggggucgaacgccguggaggacggcaaggggugcuucgagcuguaccacaagugcgacgaccagugcauggagaccauccgcaacggcaccuacaaccggaagaaguaccaggaggaguccaagcucgagcgccagaagaucgagggcgucaagcuggagucggaggggacguacaagauccugaccaucuacuccaccguggccucgucccucgucaucgccaugggcuucgccgcguuccuguucugggccaugucgaacgggagcugccgcugcaacaucugcaucuga

SEQ ID NO: 10569 - RNA, 1683 nt, Artificial Sequence; identical to SEQ ID NO: 10557
  derived and/or modified CDS sequence (AUadapt) from InfluenzaA__AGQ81190__HA

SEQ ID NO: 10570 - RNA, 1683 nt, Artificial Sequence; identical to SEQ ID NO: 10557
  derived and/or modified CDS sequence (AUadapt) from InfluenzaA__AGQ81191__HA

SEQ ID NO: 10571 - RNA, 1683 nt, Artificial Sequence; identical to SEQ ID NO: 10562
  derived and/or modified CDS sequence (AUadapt) from InfluenzaA__AGQ81192__HA

SEQ ID NO: 10572 - RNA, 1683 nt, Artificial Sequence
  derived and/or modified CDS sequence (AUadapt) from InfluenzaA__AGQ81193__HA
auggagaccgugagucugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggagcuacaucguggagcggcccuccgccgucaacggccugugcuaccccggcaacguggagaaccuggaggagcuccgcucgcuguucuccucggcccgguccuaccagcgcauccagaucuucccggacaccaucuggaacgugucguacaccgggaccuccaaggccugcagcggcuccuucuaccggucgaugcgcuggcugacccagaagaacggggacuaccccauccaggacgcgcaguacaccaacaaccagggcaagaacauccucuuuaugugggggaucaaccacccgcccacggacaccacccagcgggaccuguacacccgcacggacaccaccaccuccgucgccacggaggagaucaaccggaucuucaagccccugaucggcccccgcccccucgugaacggccugauggggcggaucgacuacuacuggucggugcugaagcccggccagacccuccgcaucaaguccgacgggaaccugaucgccccgugguacggccacguccugagcggcgagucgcacgggcggauccucaagaccgaccugaagcgcggcuccugcaccgugcagugccagacggagaagggcgggcugaacaccacccuccccuuccagaacgugucgaaguacgccuucgggaacugcuccaaguacaucggcaucaagucgcugaagcuggcggucggccuccggaacgugcccucccgcagcucccgggggcuguucggcgccaucgccggguucaucgagggcggguggucgggccugguggccggcugguacggguuccagcacuccaacgaccagggcgucgggauggccgcggaccgcgacucgacccagaaggccaucgacaagaucacguccaaggugaacaacaucguggacaagaugaauaagcaguacgagaucaucgaccacgaguucucggaggucgagacccggcucaacaugaucaacaacaagaucgacgaccagauccaggacaucugggccuacaacgccgagcugcuggugcuccuggagaaccagaagacccuggacgagcacgacgccaacgugaacaaccucuacaacaaggucaagcgcgcgcugggcuccaacgccguggaggacgggaagggcugcuucgagcuguaccacaagugcgacgaccagugcauggagaccauccggaacggcacguacaaccgccgcaaguaccaggaggagagcaagcucgagcggcagaagaucgagggggucaagcuggaguccgagggcaccuacaagauccugaccaucuacucgaccguggccuccucgcucgugaucgccaugggguucgccgcguuccuguucugggccauguccaacggcagcugccgcugcaacaucugcaucuga

SEQ ID NO: 10573 - RNA, 1683 nt, Artificial Sequence; identical to SEQ ID NO: 10557
  derived and/or modified CDS sequence (AUadapt) from InfluenzaA__AGQ81194__HA

SEQ ID NO: 10574 - RNA, 1686 nt, Artificial Sequence
  derived and/or modified CDS sequence (AUadapt) from InfluenzaA__AGQ81195__HA
auguauaagaucguggucaucaucacccugcucggcaccgugaaggggcuggacaagaucugccugggccaccacgccguggccaacgggacgaucgucaagacccucaccaacgagcaggaggaggugaccaacgcgacggagaccguggagggcaagucgcugaaccgccugugcaugaaggggcggaaccacaaggaccucggcaacugccaucccaucggcaugcugaucgggaccccggccugcgaccugcaccucaccggcacgugggacacccugaucgagcgcgagaacgccaucgccuacugcuaccccggggccaccaucaacgaggaggcgcugcggcagaagaucauggaguccggcgggaucucgaagaucuccaccggcuucacguacggcagcuccaucaacucggccgggaccacccgcgccugcaugcggaauggcgggaacuccuucuacgccgagcucaaguggcuggucagcaaguccaagggccagaacuucccccagaccacgaacaccuaccgcaacaccgacaccucggagcaccugaucauguggggcauccaccaccccuccagcacgcaggagaagaacgaucucuacgggacccagucccugucgaucuccgugggcagcuccaccuaccagaacaacuucgugccggucgugggggcgcggccccaggugaacggccagucggggcgcaucgacuuccacuggacccugguccagcccggcgacaacaucacguucucccacaauggcgggcucaucgcccccagccgggugucgaagcugaucggccgcgggcugggcauccaguccgacgccagcaucgacaacaacugcgaguccaagugcuucuggcgcgggggcucgaucaacacccggcucccguuccagaaccugagcccccggaccgugggccagugccccaaguaugucaacaagcgcucccugaugcucgccaccgggaugcggaacgugcccgagaucaugcagggccgcgggcuguucggcgccaucgcgggguucaucgagaacggcugggagggcaugguggacgggugguacggcuuccggcaccagaacgcccaggggacgggccaggccgccgacuacaaguccacccaggccgcgaucgaccagaucaccggcaagcugaaccgccucaucgagaagaccaacacggaguucgagaguaucgaguccgaguucagcgagaucgagcaccagaucgggaacgucaucaacuggaccaaggacuccaucaccgacaucuggaccuaccaggccgagcugcugguggccauggagaaccagcacacgaucgacauggccgacucggagaugcucaaccuguacgagcgggugcgcaagcagcugcggcagaacgccgaggaggauggcaaggggugcuucgagaucuaccacgcgugcgacgacuccugcauggagagcauccgcaacaacaccuacgaccacucccaguaccgcgaggaggcccuccugaaccggcugaauaucaacccggucacccucucguccggcuacaaggacaucauccugugguucagcuucggggccuccugcuucgugcugcucgccguggucaugggccugguguucuucugccugaagaacggcaacaugcgcugcaccaucugcaucuga

SEQ ID NO: 10575 - RNA, 1686 nt, Artificial Sequence
  derived and/or modified CDS sequence (AUadapt) from InfluenzaA__AGQ81196__HA
auguauaagaucguggucaucaucgcccugcucggcgccgugaaggggcuggacaagaucugccugggccaccacgcgguggccaacgggaccaucgucaagacccucacgaacgagcaggaggaggugaccaacgccaccgagaccguggagucggccucccugaaccgccugugcaugaagggccggagucacaaggaccucgggaacugccaccccaucggcaugcugaucggcacgccggccugcgaccugcaccucaccgggaccugggacacccugaucgagcgcgagaacgcgaucgccuacuguuaccccggcgccacggucaacgaggaggcccugcggcagaagaucauggaguccgggggcaucagcaagaucuccaccggguucaccuacggcucguccaucaacagcgcgggcaccacgaaggccugcaugcgcaaccgggggaauuccuucuacgccgagcucaaguggcuggugagcaaguccaagggccagaacuucccccagaccaccaacaccuaccgcaacacggacaccgccgagcaccugaucaugugggggauccaccaucccucguccacccaggagaagaacgaccucuacggcacccagagccuguccaucagcgugggcuccucgacguaccagaacaacuucgucccgguggugggggcccggccccaggucaauggccaguccgggcgcaucgacuuccacuggacccuggugcagcccggcgacaacaucaccuucagccacaacgggggccucaucgcgcccagccggguguccaagcuggucggccgcgggcugggcauccagagugacgccccgaucgacaacaacugcgaguccaagugcuucuggcgcgggggcagcaucaacacccggcuccccuuccagaaccugaguccccggacgguggggcagugccccaaguacgugaacaagcgcucccugaugcucgccaccggcaugcggaacgucccggagaucaugcagggccgcgggcuguucggcgccaucgccggguucaucgagaacggcugggaggggaugguggacggcugguacggcuuccggcaucagaacgcgcaggggaccggccaggccgccgacuacaaguccacccagacggccaucgaccagaucaccgggaagcugaaccgccucaucgagaagaccaacaccgaguucgagucgaucgaguccgaguucagcgagaucgagcaccagaucggcaaugugaucaacuggacgaaggacuccaucaccgacaucuggaccuaccaggccgagcugcuggucgcgauggagaaccagcacaccaucgacauggccgacagcgagaugcucaaccuguacgagcgggugcgcaagcagcugcggcagaaugccgaggaggacggcaaggggugcuucgagaucuaccacgccugcgacgacuccugcauggagucgauccgcaauaacacguacgaccacucccaguaccgcgaggaggcccuccugaaccggcugaacaucaaccccgugaagcucagcuccggcuacaaggacaucauccugugguuuagcuucggggcguccugcuucguccugcucgccguggucaugggccugguguucuucugccugaagaacgggaacaugcgcugcaccaucugcaucuga

SEQ ID NO: 10576 - RNA, 1686 nt, Artificial Sequence
  derived and/or modified CDS sequence (AUadapt) from InfluenzaA__AGQ81198__HA
auguauaagaucguggucaucaucgcccugcucggcgccgugaaggggcuggacaagaucugccugggccaccacgcgguggccaacgggaccaucgucaagacccucacgaacgagcaggaggaggugaccaacgccaccgagaccguggagucgacgucccugaaccgccugugcaugaagggccggaaccacaaggaccucgggaacugccaccccaucggcaugcugaucggcaccccggccugcgaccugcaucucaccgggaccugggacacgcugaucgagcgcgagaacgccaucgcguacugcuaccccggcgccaccaucaacgaggaggcccugcggcagaagaucauggagucggggggcaucuccaagaucagcaccggguucaccuacggcuccucgaucaacuccgccggcaacacgaaggcgugcaugcgcaacgggggcaacucguucuaugccgagcuccgguggcuggucuccaagaacaaggggcagaacuucccccagaccaccaacaccuaccgcaacacggacaccgccgagcaccugaucaucuggggcauccaccaccccagcuccaccaaggagaagaacgaccucuacggcacccagucgcuguccaucucggugggguccagcacguaccagaauaacuucgugccggucgugggcgcccggccccaggugaacgggcaguccggccgcaucgacuuccacuggacccugguccagcccggggacaacaucaccuucucgcacaacggcggccucaucgcccccucccgggugucgaagcugaucgggcgcggccuggggauccagagcgacgcgccgaucgacaacaacugugaguccaagugcuucuggcggggcgggucgaucaacacccgccuccccuuccagaaccugucgccccggacggugggccagugccccaaguacgucaacaagaagucccugaugcucgccaccggcaugcgcaacgugccggagaucaugcaggggcggggccuguucggggccaucgccggcuucaucgagaacgggugggagggcaugguggacggcugguacggguuccgccaccagaaugcccagggcaccgggcaggcggccgacuacaaguccacccaggccgccaucgaccagaucacgggcaagcugaaccggcucaucgagaagaccaacaccgaguucgagagcaucgaguccgaguucucggagaucgagcaccagaucggcaacgucaucaacuggaccaaggacuccaucacggacaucuggaccuaccaggccgagcugcugguggcgauggagaaccagcacaccaucgacauggccgauucggagaugcucaaccuguacgagcgcgugcggaagcagcugcgccagaacgccgaggaggacgggaagggcugcuucgagaucuaccacgccugcgacgacuccugcauggagagcauccggaacaacaccuacgaccauucccaguaccgcgaggaggcccuccugaaccgccugaacaucaaccccgucacgcucucguccggguacaaggacaucauccugugguucagcuucggcgcguccugcuucgugcugcucgccguggucauggggcugguguucuucugccugaagaacggcaacaugcggugcaccaucugcaucuga

SEQ ID NO: 10577 - RNA, 1686 nt, Artificial Sequence
  derived and/or modified CDS sequence (AUadapt) from InfluenzaA__AGQ81199__HA
auguauaagaucguggucaucaucgcccugcucggcgccgugaaggggcuggacaagaucugccugggccaccacgcgguggccaacgggaccaucgucaagacccucacgaacgagcaggaggaggugaccaacgccaccgagaccguggagucggccucccugaaccgccugugcaugaagggccggagucacaaggaccucgggaacugccaccccaucggcaugcugaucggcacgccggccugcgaccugcaccucaccgggaccugggacacccugaucgagcgcgagaacgcgaucgccuacuguuaccccggcgccacggucaacgaggaggcccugcggcagaagaucauggaguccgggggcaucagcaagaucuccaccggguucaccuacggcucguccaucaacagcgcgggcaccacgaaggccugcaugcgcaacgggggcaauuccuucuacgccgagcucaaguggcuggugagcaaguccaaggggcagaacuucccccagaccaccaacaccuaccggaacacggacaccgccgagcaccugaucauguggggcauccaccaucccucguccacccaggagaagaacgaccucuacggcacccagagccuguccaucagcgugggguccucgacguaccagaacaacuucgucccgguggugggcgcccgcccccaggucaaugggcaguccggccggaucgacuuccacuggacccuggugcagcccggggacaacaucaccuucagccacaacggcggccucaucgcgcccagccgcguguccaagcuggucgggcggggccuggggauccagagugacgccccgaucgacaacaacugcgaguccaagugcuucuggcgcggcgggagcaucaacacccggcuccccuuccagaaccugaguccccgcacggugggccagugccccaaguacgugaacaagcggucccugaugcucgccaccggcaugcgcaacgucccggagaucaugcaggggcggggccuguucggggccaucgccggcuucaucgagaacgggugggagggcaugguggacggcugguacggguuccgccaucagaacgcgcagggcaccgggcaggccgccgacuacaaguccacccagacggccaucgaccagaucaccggcaagcugaaccggcucaucgagaagaccaacaccgaguucgagucgaucgaguccgaguucagcgagaucgagcaccagaucggcaaugugaucaacuggacgaaggacuccaucaccgacaucuggaccuaccaggccgagcugcuggucgcgauggagaaccagcacaccaucgacauggccgacagcgagaugcucaaccuguacgagcgcgugcggaagcagcugcgccagaaugccgaggaggacgggaagggcugcuucgagaucuaccacgccugcgacgacuccugcauggagucgauccggaauaacacguacgaccacucccaguaccgcgaggaggcccuccugaaccgccugaacaucaaccccgugaagcucagcuccggguacaaggacaucauccugugguuuagcuucggcgcguccugcuucguccugcucgccguggucauggggcugguguucuucugccugaagaacggcaacaugcggugcaccaucugcaucuga

SEQ ID NO: 10578 - RNA, 1698 nt, Artificial Sequence
  derived and/or modified CDS sequence (AUadapt) from InfluenzaA__AGQ81200__HA
augaagaagacccuccuguucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucgggcugggcgacugcagcuucgccggguggauccugggcaacccgaugugcgacgaccucaucggcaagaccuccuggagcuacaucguggagaagcccaaccccgccaacgggaucugcuaccccggcacccuggagaacgaggaggagcugcgccucaaguucuccgggguccuggaguucagcaaguucgaggccuucaccuccacgggcuggggcgccgugaacagcggggcgggcgugaccgccgccugcaaguucggguccagcaacuccuucuuccggaacauggucuggcugauccaccagagcggcaccuacccggugaucaagcgcaccuucaacaacacgaaggggcgggacgugcucgucguguggggcauccaccaccccgccacccugaaggagcaccaggaccuguacaagaaggacuccagcuacguggcggucggcuccgagaccuacaaccgccgguucauccccgagaucagcacccgccccaaggugaacgggcaggccggccggaugacguucuacuggaccaucgugaagccgggggagagcaucaccuucgaguccaacggcgccuuccucgcgccccgcuacgccuucgagaucgucagcguggggaacggcaagcuguuccgguccgagcugaacaucgagagcugcuccaccaagugccagacggagaucggcgggaucaacaccaacaagagcuuccacuccgugcaccgcaacaccaucggcgacugccccaaguacgucaacgucaagagccucaagcuggccaccgggcugcggaacgugcccgccaucgccucccgcggccucuucggggccaucgccggcuucaucgagggcggguggccgggccugaucaacgggugguacggcuuccagcaccggaacgaggaggggacgggcaucgcggccgacaaggagagcacccagaaggccaucgaccagaucaccuccaaggugaacaacaucguggacaagaugaacaccaacuucgagagcguccagcacgaguucuccgagaucgaggagcgcaucaaccagcugagcaagcacguggacgacuccguggucgacaucuggagcuacaacgcccagcuccuggugcugcucgagaacgagaagacgcuggaccugcacgacuccaacgugcggaaccuccacgagaagguccgccggaugcugaaggacaacgccaaggacgagggcaacgggugcuucaccuucuaccacaagugcgacaacgagugcaucgagcgcgugcggaacggcaccuacgaccacaaggaguucgaggaggagagcaagaucaaccgccaggagaucgagggggugaagcuggacuccagcggcaacgucuacaagauccucagcaucuacuccugcaucgcgagcucccuggugcuggccgcccucaucaugggcuucauccugugggccugcagcaacggguccugccggugcaccaucugcaucuga

SEQ ID NO: 10579 - RNA, 1698 nt, Artificial Sequence
  derived and/or modified CDS sequence (AUadapt) from InfluenzaA__AGQ81202__HA
augaagaagacccuccucuucgccgccaucuuccuguacgugaaggcggacgagaucugcaucggcuaccugucgaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacaccgucuggcugauccaccaguccgggaccuacccggugaucaagcgcaccuucaacaacacgaagggccgggacgugcucgucguguggggcgugcaccaccccgccacccugaaggagcaccaggaccuguacaagaaggacagcuccuacgucgcgguggggagcgagaccuacaaccgccgguucauccccgagaucagcacccgccccaaggugaacggccaggccgggcggaugacguucuacuggaccaucgucaagccgggcgaguccaucaccuucgagagcaacggggccuuccucgcgccccgcuacgccuucgagaucguguccgugggcaacgggaagcuguuccggucggagcugaacaucgaguccugcagcaccaagugccagacggagaucggcggcaucaacaccaacaaguccuuccacagcguccaccgcaacaccaucggggacugccccaaguacgugaacgugaagucccucaagcuggccaccggccugcggaacguccccgccaucgccagccgcgggcuguucggcgccaucgccggguucaucgagggcggcuggccggggcugaucaacggcugguacggguuccagcaccggaacgaggagggcacggggaucgcggccgacaaggaguccacccagaaggccaucgaccagaucaccagcaaggugaacaacaucgucgaccgcaugaacaccaacuucgaguccgugcagcacgagagcuccgagaucgaggagcggaucaaccagcugagcaagcacguggacgacuccauggucgacaucuggagcuacaacgcccagcuccuggugcugcucgagaacgagaagacgcuggaccugcacgacuccaacgugcgcaaccuccacgagaagguccggcgcaugcugaaggacaacgccaaggacgagggcaacggcugcuucaccuucuaccacaagugcgacaacaagugcaucgagcgggugcgcaacgggaccuacgaccacaaggaguucgaggaggagagcaagaucaaccggcaggagaucgagggcgugaagcuggacagcuccgggaacgucuacaagauccucagcaucuacuccugcaucgcgagcucccuggugcuggccgcccucaucaugggcuucauccugugggccugcagcaacggcuccugccgcugcaccaucugcaucuga

SEQ ID NO: 10580 - RNA, 1698 nt, Artificial Sequence
  derived and/or modified CDS sequence (AUadapt) from InfluenzaA__AGQ81203__HA
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucaacaaguucgaggccuucaccuccaacggguggggcgccgugaacagcggggcgggcgugacggccgccugcaaguucggcuccagcaacuccuucuuccggaacauggucuggcugauccaccagagcgggaccuacccggugaucaagcgcaccuucaacaacaccaagggccgggacgugcucgucgugugggggauccaccaccccgccacgcugaaggagcaccaggaccuguacaagaaggacuccagcuacguggcggucggcuccgagaccuacaaccgccgguucauccccgagaucagcacccgccccaaggugaacggccaggccgggcggaugaccuucuacuggacgaucgugaagccgggcgagagcaucaccuucgaguccaacggggccuuccucgcgccccgcuacgccuucgagaucgucagcgugggcaacgggaagcuguuccgguccgagcugaacaucgagagcugcuccaccaagugccagaccgagaucggcggcaucaacacgaacaagagcuuccacuccgugcaccgcaacaccaucggggacugccccaaguacgucaacgucaagagccucaagcuggccaccggccugcggaacgugcccgccaucgccucccgcgggcuguucggcgccaucgccggguucaucgagggcggcuggccggggcugaucaacggcugguacggguuccagcaccggaacgaggagggcaccgggaucgcggccgacaaggagagcacgcagaaggccaucgaccagaucaccuccaaggugaacaacaucguggaccgcaugaacaccaacuucgagagcguccagcacgaguucuccgagaucgaggagcggaucaaccagcugagcaagcacguggacgacuccguggucgacaucuggagcuacaacgcccagcuccuggugcugcucgagaacgagaagacccuggaccugcacgacuccaacgugcgcaaccuccacgagaagguccggcgcaugcugaaggacaacgccaaggacgagggcaacggcugcuucacguucuaccacaagugcgacaacgagugcaucgagcgggugcgcaacgggaccuacgaccacaaggaguucgaggaggagagcaagaucaaccggcaggagaucgagggcgugaagcuggacuccagcgggaacgucuacaagauccucagcaucuacuccugcaucgcgagcucccuggugcuggccgcccucaucaugggcuucauccugugggccugcagcaacggcuccugccgcugcaccaucugcaucuga

SEQ ID NO: 10581 - RNA, 1698 nt, Artificial Sequence
  derived and/or modified CDS sequence (AUadapt) from InfluenzaA__AGQ81204__HA
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucaacaaguucgaggccuucaccuccaacggguggggcgccgugaacagcggggcgggcgugacggccgccugcaaguucggcuccagcaacuccuucuuccggaacauggucuggcugauccaccagagcgggaccuacccggugaucaagcgcaccuucaacaacaccaagggccgggacgugcucgucgugugggggauccaccaccccgccacgcugaaggagcaccaggaccuguacaagaaggacuccagcuacguggcggucggcuccgagaccuacaaccgccgguucauccccgagaucagcacccgccccaaggugaacggccaggccgggcggaugaccuucuacuggacgaucgugaagccgggcgagagcaucaccuucgaguccaacggggccuuccucgcgccccgcuacgccuucgagaucgucagcgugggcaacgggaagcuguuccgguccgagcugaacaucgagagcugcuccaccaagugccagaccgagaucggcggcaucaacacgaacaagagcuuccacuccgugcaccgcaacaccaucggggacugccccaaguacgucaacgucaagagccucaagcuggccaccggccugcggaacgugcccgccaucgccucccgcgggcuguucggcgccaucgccggguucaucgagggcggcuggccggggcugaucaacggcugguacggguuccagcaccggaacgaggagggcaccgggaucgcggccgacaaggagagcacgcagaaggccaucgaccagaucaccuccaaggugaacaacaucguggaccgcaugaacaccaacuucggcagcguccagcacgaguucuccgagaucgaggagcggaucaaccagcugagcaagcacguggacgacuccguggucgacaucuggagcuacaacgcccagcuccuggugcugcucgagaacgagaagacccuggaccugcacgacuccaacgugcgcaaccuccacgagaagguccggcgcaugcugaaggacaacgccaaggacgagggcaacgggugcuucacguucuaccacaagugcgacaacgagugcaucgagcgggugcgcaacggcaccuacgaccacaaggaguucgaggaggagagcaagaucaaccggcaggagaucgagggggugaagcuggacuccagcggcaacgucuacaagauccucagcaucuacuccugcaucgcgagcucccuggugcuggccgcccucaucaugggcuucauccugugggccugcagcaacggguccugccgcugcaccaucugcaucuga

SEQ ID NO: 10582 - RNA, 1698 nt, Artificial Sequence
  derived and/or modified CDS sequence (AUadapt) from InfluenzaA__AGQ81205__HA
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucaacaaguucgaggccuucaccuccaacggguggggcgccgugaacagcggggcgggcgugacggcgaccugcaaguucggcuccagcaacuccuucuuccggaacauggucuggcugauccaccagagcgggaccuacccggugaucaagcgcaccuucaacaacacgaagggccgggacgugcucgucgugugggggauccaccaccccgccacccugaaggagcaccaggaccuguacaagaaggacuccagcuacguggccgucggcuccgagaccuacaaccgccgguucauccccgagaucagcacccgccccaaggugaacggccaggccgggcggaugacguucuacuggaccaucgugaagccgggcgagagcaucaccuucgaguccaacggggccuuccucgcgccccgcuacgccuucgagaucgucagcgugggcaacgggaagcuguuccgguccgagcugaacaucgagagcugcuccaccaagugccagacggagaucggcggcaucaacaccaacaagagcuuccacuccgugcaccgcaacaccaucggggacugccccaaguacgucaacgucaagagccucaagcuggccaccggccugcggaacgugcccgccaucgccucccgcgggcuguucggcgccaucgccggguucaucgagggcggcuggccggggcugaucaacggcugguacggguuccagcaccggaacgaggagggcacggggaucgccgcggacaaggagagcacccagaaggccaucgaccagaucaccuccaaggugaacaacaucguggaccgcaugaacaccaacuucgagagcguccaguacgaguucuccgagaucgaggagcggaucaaccagcugagcaagcacguggacgacuccguggucgacaucuggagcuacaacgcccagcuccuggugcugcucgagaacgagaagacgcuggaccugcacgacuccaacgugcgcaaccuccacgagaagguccggcgcaugcugaaggacaacgccaaggacgagggcaacggcugcuucaccuucuaccacaagugcgacaacgagugcaucgagcgggugcgcaacgggaccuacgaccacaaggaguucgaggaggagagcaagaucaaccggcaggagaucgagggcgugaagcuggacuccagcgggaacgucuacaagauccucagcaucuacuccugcaucgccagcucccuggugcuggcggcccucaucaugggcuucauccugugggccugcagcaacggcuccugccgcugcaccaucugcaucuga

SEQ ID NO: 10583 - RNA, 1698 nt, Artificial Sequence
  derived and/or modified CDS sequence (AUadapt) from InfluenzaA__AGQ81206__HA
augaagaagacccuccucuucgccgccaucuuccuguacgcgaaggccgacgagaucugcaucggcuaccugucgaacaacuccaccgacaagguggacacgaucaucgagaacaacgucaccgugaccagcuccguggagcucgucgagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgcagcaaguucuccggcgugcucgaguucagcaaguucgaggccuucaccuccaacggguggggcgcggucaacagcggggccggcgugacggccgccugcaaguucggcuccagcaacuccuucuuccggaacaugguguggcugauccaccagagcgggaccuacccggucaucaagcgcaccuucaacaacaccaagggccgggacgugcugguggucugggggauccaccaccccgcgacgcucaaggagcaccaggaccuguacaagaaggacuccagcuacguggccgugggcagcgagaccuacaaccgccgguucauccccgagaucuccacccgccccaaggucaacggccaggccgggcggaugaccuucuacuggacgaucgugaagccggaggagagcaucaccuucgaguccaacggcgccuuccuggcgccccgcuacgccuucgagaucgugagcgucgggaacggcaagcuguuccgguccgagcugaacaucgagagcugcuccaccaagugccagaccgagaucgggggcaucaacacgaacaagagcuuccacuccgugcaccgcaacaccaucggcgacugccccaaguacgugaacgucaagagccugaagcucgccaccgggcugcggaacgugcccgccaucgccucccgcggccuguucggggccaucgcgggcuucaucgagggcggguggccgggccucaucaacgggugguacggcuuccagcaccggaacgaggaggggaccggcaucgccgccgacaaggagagcacgcagaaggccaucgaccagaucaccuccaaggugaacaacaucgucgaccgcaugaacaccaacuucgagagcgugcagcacgaguucuccgagaucgaggagcggaucaaccagcugagcaagcacgucgacgacuccgugguggacaucuggagcuacaacgcccagcugcucguccugcuggagaacgagaagacccucgaccugcacgacuccaacgugcgcaaccugcacgagaaggugcggcgcaugcucaaggacaacgcgaaggacgaggggaacggcugcuucacguucuaccacaagugcgacaacgagugcaucgagcggguccgcaacggcaccuacgaccacaaggaguucgaggaggagagcaagaucaaccggcaggagaucgagggggugaagcuggacagcuccggcaacguguacaagauccugagcaucuacuccugcaucgccagcucccucauccuggccgcccugaucaugggguucauccucugggccugcagcaacggcuccugccgcugcaccaucugcaucuga

SEQ ID NO: 10584 - RNA, 1698 nt, Artificial Sequence
  derived and/or modified CDS sequence (AUadapt) from InfluenzaA__AGQ81209__HA
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcauccuggaguucuccaaguucgaggccuucaccagcaacggguggggcgccgucaacuccggggcgggcgugacggccgccugcaaguucggcagcuccaacagcuucuuccggaacaugguguggcugauccaccaguccgggaccuacccggucaucaagcgcaccuucaacaacaccaagggccgggacgugcucaucgugugggggauccaccaccccgccacgcugaaggagcaccaggaccuguacaagaaggacagcuccuacgucgcggugggcagcgagaccuacaaccgccgguucauccccgagaucagcacccgccccaaggugaacggccaggccgggcggaugaccuucuacuggacgaucgucaagccgggcgaguccaucaccuucgagagcaacggggccuuccucgcgccccgcuacgccuucgagaucguguccgugggcaacgggaagcuguuccggagcgagcugaacaucgaguccugcagcaccaagugccagaccgagaucggcggcaucaacacgaacaaguccuuccacagcguccaccgcaacaccaucggggacugccccaaguacgugaacgugaagucccucaagcuggccaccggccugcggaacguccccgccaucgccagccgcgggcuguucggcgccaucgccggguucaucgagggcggcuggccggggcugaucaacggcugguacggguuccagcaccggaacgaggagggcaccgggaucgcggccgacaaggaguccacgcagaaggccaucgaccagaucaccagcaaggugaacaacaucguggaccgcaugaacaccaacuucgaguccguccagcacgaguucagcgagaucgaggagcggaucaaccagcuguccaagcacguggacgacagcgucguggacaucugguccuacaacgcccagcuccuggugcugcucgagaacgagaagacccuggaccugcacgacagcaacguccgcaaccuccacgagaaggugcggcgcaugcugaaggacaacgccaaggacgagggcaacggcugcuucacguucuaccacaagugcgacaacgagugcaucgagcgggugcgcaacgggaccuacgaccacaaggaguucgaggaggaguccaagaucaaccggcaggagaucgagggcgucaagcuggacagcagcgggaacguguaccgcauccucuccaucuacagcugcaucgcguccagccuggugcuggccgcccucaucaugggcuucauccugugggccugcuccaacggcagcugccgcugcaccaucugcaucuga

SEQ ID NO: 10585 - RNA, 1698 nt, Artificial Sequence
  derived and/or modified CDS sequence (AUadapt) from InfluenzaA__AGQ81211__HA
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaucaagcgcaccuucaacaacaccaagggccgggacgugcucaucgucugggggauccaccaccccgccacgcugaaggagcaccaggaccuguacaagaaggacagcuccuacguggcggugggcagcgagaccuacaaccgccgguucauccccgagaucagcacccgccccaaggucaacggccaggccgggcggaugaccuucuacuggacgaucgugaagccgggcgaguccaucaccuucgagagcaacggggccuuccucgcgccccgcuacgccuucgagaucguguccgucggcaacgggaagcuguuccggagcgagcugaacaucgaguccugcagcaccaagugccagaccgagaucggcggcaucaacacgaacaaguccuuccacagcgugcaccgcaacaccaucggggacugccccaaguacgugaacgucaagucccucaagcuggccaccggccugcggaacgugcccgccaucgccagccgcgggcuguucggcgccaucgccggguucaucgagggcggcuggccggggcugaucaacggcugguacggguuccagcaccggaacgaggagggcaccgggaucgcggccgacaaggaguccacgcagaaggccaucgaccagaucaccagcaaggugaacaacaucgucgaccgcaugaacaccaacuucgaguccgugcagcacgaguucagcgagaucgaggagcggaucaaccagcuguccaagcacgucgacgacagcgugguggacaucugguccuacaacgcccagcuccugguccugcucgagaacgagaagacccuggaccugcacgacuucaacgugcgcaaccuccacgagaaggugcggcgcaugcugaaggacaacgccaaggacgagggcaacggcugcuucacguucuaccacaagugcgacaacgagugcaucgagcggguccgcaacgggaccuacgaccacaaggaguucgaggaggagagcaagaucaaccggcaggagaucgagggcgugaagcuggacuccagcgggaacguguaccgcauccucagcaucuacuccugcaucgcgagcucccugguccuggccgcccucaucaugggcuucauccugugggccugcagcaacggcuccugccgcugcaccaucugcaucuga

SEQ ID NO: 10586 - RNA, 1698 nt, Artificial Sequence
  derived and/or modified CDS sequence (AUadapt) from InfluenzaA__AGQ81213__HA
augaagaagacccuccucuucgccgccaucuuccuguacgugcgcgcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacggccucaucggcaagaccagcugguccuacaucguggagaagcccaaccccgccaacgggaucugcuaccccggcacccuggagaacgaggaggagcugcggcucaaguucagccgcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaucaagcgcaccuucaacaacaccaagggccgggacgugcucgucgugugggggauccaccaccccgccacgcugaaggagcaccaggaccuguacaagaaggacagcuccuacguggcggucggcagcgagaccuacaaccgccgguucauccccgagaucagcacccgccccaccgugaacggccaggccgggcggaugacguucuacuggaccaucgugaagccgggcgaguccaucaccuucgagagcaacggggccuuccucgcgccccgcuacgccuucgagaucgucuccgugggcaacgggaagcuguuccggagcgagcugaacaucgaguccugcagcaccaagugccagacggagaucggcggcaucaacaccaacaaguccuuccacagcgugcaccgcaacaccaucggggacugccccaaguacgucaacgugaagucccucaagcuggccaccggccugcggaacgugcccgccaucgccagccgcgggcuguucggcgccaucgccggguucaucgagggcggcuggccggggcugaucaacggcugguacggguuccagcaccggaacgaggagggcacggggaucgcggccgacaaggaguccacccagaaggccaucgaccagaucaccagcaaggucaacaacaucguggaccgcaugaacaccaacuucgaguccguccagcacgaguucagcgagaucgaggagcggaucaaccagcuguccaagcacguggacgacagcguggucgacaucugguccuacaacgcccagcuccuggugcugcucgagaacgagaagacgcuggaccugcacgacagcaacgugcgcaaccuccacgagaagguccggcgcaugcugaaggacaacgccaaggacgagggcaacggcugcuucaccuucuaccacaagugcgacaacgagugcaucgagcgggugcgcaacgggaccuacgaccacaaggaguucgaggaggaguccaagaucaaccgccaggagaucgagggcgugaagcuggacagcagcgggaacgucuacaagauccucuccaucuacagcugcaucgcguccagccuggugcuggccgcccucaucaugggcuucauccugugggccugcuccaacggcagcugccggugcaccaucugcaucuga

SEQ ID NO: 10587 - RNA, 1698 nt, Artificial Sequence
  derived and/or modified CDS sequence (AUadapt) from InfluenzaA__AGQ81214__HA
augaagaagacccuccucuucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaucaagcgcaccuucaacaacaccaagggccgggacgugcucaucgucugggggauccaccaccccgccacgcugaaggagcaccaggaccuguacaagaaggacagcuccuacguggcggugggcagcgagaccuacaaccgccgguucauccccgagaucagcacccgccccaaggucaacggccaggccgggcggaugaccuucuacuggacgaucgugaagccgggcgaguccaucaccuucgagagcaacggggccuuccucgcgccccgcuacgccuucgagaucguguccgucggcaacgggaagcuguuccggagcgagcugaacaucgaguccugcagcaccaagugccagaccgagaucggcggcaucaacacgaacaaguccuuccacagcgugcaccgcaacaccaucggggacugccccaaguacgugaacgucaagucccucaagcuggccaccggccugcggaacgugcccgccaucaccagccgcgggcuguucggcgccaucgccggguucaucgagggcggcuggccggggcugaucaacggcugguacggguuccagcaccggaacgaggagggcacggggaucgccgcggacaaggaguccacccagaaggccaucgaccagaucaccagcaaggugaacaacaucgucgaccgcaugaacaccaacuucgaguccgugcagcacgaguucagcgagaucgagggccggaucaaccagcuguccaagcacgucgacgacagcgugguggacaucugguccuacaacgcccagcuccugguccugcucgagaacgagaagacgcuggaccugcacgacagcaacgugcgcaaccuccacgagaaggugcggcgcaugcugaaggacaacgccaaggacgagggcaacgggugcuucaccuucuaccacaagugcgacaacgagugcaucgagcggguccgcaacggcaccuacgaccacaaggaguucgaggaggaguccaagaucaaccggcaggagaucgagggggugaagcuggacagcagcggcaacguguacaagauccucuccaucuacagcugcaucgccuccagccugguccuggcggcccucaucaugggcuucauccugugggccugcuccaacgggagcugccgcugcaccaucugcaucuga

SEQ ID NO: 10588 - RNA, 1698 nt, Artificial Sequence
  derived and/or modified CDS sequence (AUadapt) from InfluenzaA__AGQ81215__HA
augaagaagacccuccuguucgccgccaucuuccuguacgugaaggcggacgagaucugcaucggcuaccugagcaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacggccucaucggcaagaccagcugguccuacaucguggagaagcccaaccccgccaacgggaucugcuaccccggcacccuggagaacgaggaggagcugcgccucaaguucagcgggauccuggaguucuccaaguucgaggccuucaccagcaacggcuggggcgccgucaacuccggggcgggcgugacggccgccugcaaguucgggagcuccaacagcuucuuccggcacaugguguggcugauccaccaguccggcaccuacccggucaucaagcgcaccuucaacaacaccaaggggcgggacgugcucguggucuggggcauccaccaccccgccacgcugaaggagcagcaggaccuguacaagaaggacagcuccuacguggcggugggcagcgagaccuacaaccgccgguucauccccgagaucagcacccgccccaaggucaacgggcaggccggccggaugaccuucuacuggacgaucgugaagccgggggaguccaucaccuucgagagcaacggcgccuuccucgcgccccgcuacgccuucgagaucguguccgucgggaacggcaagcuguuccggagcgagcugaacaucgaguccugcagcaccaagugccagaccgagaucggcgggaucaacacgaacaaguccuuccacagcgugcaccgcaacaccaucggcgacugccccaaguacgugaacgucaagucccucaagcuggccaccgggcugcggaacgugcccgccaucgccagccgcggccucuucggggccaucgccggcuucaucgagggcggguggccgggccugaucaacgggugguacggcuuccagcaccggaacgaggaggggaccggcaucgcggccgacaaggaguccacgcagaaggccaucgaccagaucaccagcaaggugaacaacaucgucgaccgcaugaacaccaacuucgaguccgugcagcacgaguucagcgagaucgaggagcggaucaaccagcuguccaagcacgucgacgacagcgugguggacaucugguccuacaacgcccagcuccugguccugcucgagaacgagaagacccuggaccugcacgacagcaacgugcgcaaccuccacgagaaggugcggcgcaugcugaaggacaacgccaaggacgagggcaacgggugcuucacguucuaccacaagugcgacaacgagugcaucgagcggguccgcaacggcaccuacgaccacaaggaguucgaggaggaguccaagaucaaccggcaggagaucgagggggugaagcuggacagcagcggcaacguguacaagauccucuccaucuacagcugcaucgcguccagccugguccuggccgcccucaucaugggcuucauccugugggccugcuccaacgggagcugccgcugcaccaucugcaucuga

SEQ ID NO: 10589 - RNA, 1698 nt, Artificial Sequence
  derived and/or modified CDS sequence (AUadapt) from InfluenzaA__AGQ81216__HA
augaagaagacccuccucuucgccgccaucuuccuguacgugaaggcggacgagaucugcaucggcuaccugucgaacaacuccaccgacaaggucgacacgaucaucgagaacaacgugaccgugaccagcuccgucgagcucguggagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcguccuggaguucuccaaguucgaggccuucaccagcaacggguggggcgccgugaacuccggggcgggcgugacggccgccugcaaguucggcagcuccaacagcuucuuccggaacauggucuggcugauccaccaguccgggaccuacccggugaccaagcgcaccuucaacaacacgaagggccgggacgugcucgucgugugggggauccaccaccccgccacccugaaggagcaccaggaccuguacaagaaggacagcuccuacguggcggucggcagcgagaccuacaaccgccgguucacccccgagaucagcacgcgccccaaggugaacggccaggccgggcggaugaccuucuacuggaccaucgugaagccgggcgaguccaucaccuucgagucgaacggggccuuccucgcgccccgcuacgccuucgagaucgucuccgugggcaacgggaagcuguuccggagcgagcugaacaucgaguccugcagcacgaagugccagaccgagaucggcggcaucaacaccaacaaguccuuccacagcgugcaccgcaacaccaucggggacugccccaaguacgucaacgugaagucccucaagcuggccacgggccugcggaacgugcccgccaucgccagcaaggggcuguucggcgccaucgccggguucaucgagggcggcuggccggggcugaucaacggcugguacggguuccagcaccgcaacgaggagggcaccgggaucgcggccgacaaggaguccacccagaaggccaucgaccagaucaccagcaaggucaacaacaucguggaccggaugaacacgaacuucgaguccguccgccacgaguucagcgagaucgaggagcggaucaaccagcuguccaagcacguggacgacagcguggucgacaucugguccuacaacgcccagcuccuggugcugcucgagaacgagaagacccuggaccugcacgacagcaacgugcgcaaccuccacgagcggguccgccggaugcugaaggacaacgccaaggacgagggcaacggcugcuucaccuucuaccacaagugcgacaacgagugcaucgagcgcgugcggaacgggaccuacgaccacaaggaguucgaggaggaguccaagaucaaccgccaggagaucgagggcgugaagcuggacagcagcgggaacgucuacaagauccucuccaucuacagcugcaucgcguccagccuggugcuggccgcccucaucaugggcuucauccugugggccugcggcaacggguccugccgcugcacgaucugcaucuga

SEQ ID NO: 10590 - RNA, 1698 nt, Artificial Sequence
  derived and/or modified CDS sequence (AUadapt) from InfluenzaA__AGQ81217__HA
augaagaagacccuccuguucgccgccaucuuccuguacgcgaaggccgacgagaucugcaucggcuaccugucgaacaacuccaccgacaagguggacacgaucaucgagaacaacgucaccgugaccagcuccguggagcucgucgagaccgagcacacggggagcuucugcuccaucaacggcaagcagcccaucagccugggggacugcuccuucgccggcuggauccuggggaacccgaugugcgacgaccucaucggcaagaccagcugguccuacaucguggagaagcccaaccccgccaacggcaucugcuaccccgggacccuggagaacgaggaggagcugcgccucaaguucagcggcgugcuggaguucucccgguucgaggccuucaccagcaacggguggggcgcggucaacuccggggccggcgugacggccgccugcaaguucggcagcuccaacagcuucuuccgcaacaugguguggcugauccaccaguccgggaccuacccggucaucaagcggaccuucaacaacaccaagggccgcgacgugcucguggucugggggauccaccaccccgcgacgcugaaggagcaccaggaccuguacaagaaggacagcuccuacguggccgugggcagcgagaccuacaaccggcgcuucauccccgagaucagcacccggcccaaggucaacggccaggccgggcgcaugaccuucuacuggacgaucgugaagccggaggaguccaucaccuucgagagcaacggcgccuuccucgcgccccgguacgccuucgagaucguguccgucgggaacggcaagcuguuccgcagcgagcugaacaucgaguccugcagcaccaagugccagaccgagaucgggggcaucaacacgaacaaguccuuccacagcgugcaccggaacaccaucggcgacugccccaaguacgugaacgucaagucccucaagcuggccaccgggcugcgcaacgugcccgccaucgccagccggggccucuucggggccaucgcgggcuucaucgagggcggguggccgggccugaucaacgggugguacggcuuccagcaccgcaacgaggaggggaccggcaucgccgccgacaaggaguccacgcagaaggccaucgaccagaucaccagcaaggugaacaacaucgucgaccggaugaacaccaacuucgaguccgugcagcacgaguucagcgagaucgaggagcgcaucaaccagcuguccaagcacgucgacgacagcgugguggacaucugguccuacaacgcccagcuccugguccugcucgagaacgagaagacccuggaccugcacgacagcaacgugcggaaccuccacgagaaggugcgccggaugcugaaggacaacgcgaaggacgaggggaacggcugcuucacguucuaccacaagugcgacaacgagugcaucgagcgcguccggaacggcaccuacgaccacaaggaguucgaggaggaguccaagaucaaccgccaggagaucgagggggugaagcuggacagcagcggcaacguguacaagauccucuccaucuacagcugcaucgccuccagccugauccuggccgcccucaucaugggguucauccugugggccugcuccaacggcagcugccgcugcaccaucugcaucuga

SEQ ID NO: 10591 - RNA, 1704 nt, Artificial Sequence
  derived and/or modified CDS sequence (AUadapt) from InfluenzaA__AGQ88499__HA
auggagaagaucgugcugcuguucgccaccaucucgcuggucaaguccgaccacaucugcaucggcuaccacgccaacaacucgaccgagcaggucgacacgaucauggagaagaacgugaccgugacccacgcgcaggacauccuggagaagacccacaacgggaagcucugcgaccugaacggcgugaagccccugauccucaaggacugcuccguggccggguggcugcugggcaacccgaugugcgacgaguucaucaacguccccgaguggagcuacaucguggagaaggccaaccccgccaacgaccucugcuaccccgggaacuucaacgacuacgaggagcugaagcaccuccucucccgcaucaaccacuucgagaagauccagaucaucccgaaggacucguggacggaccacgaggccucccugggcgugucggcggccugccccuaccagggcaacuccagcuucuuccggaacgucguguggcugaucaagaaggacaacgccuaccccaccaucaagaagggguacaacaacaccaaccaggaggaccuccuggugcuguggggcauccaccaccccaacaacgaggccgagcagacccgccucuaccagaacccgacgaccuacaucuccaucgggaccucgacccugaaccagcggcugguccccaagaucgcgacgcgcuccaagaucaacggccagucggggcggaucgacuucuucuggaccauccucaagcccaacgacgccauccacuucgaguccaacggcaacuucaucgcccccgaguacgccuacaagaucgugaagaagggcgacagcaccaucaugaaguccgagguggaguacgggaacugcaacacccgcugccagacgccgaucggcgccaucaacucguccaugcccuuccacaacauccacccccugaccaucggggagugccccaaguacgucaagucgaacaagcuggugcucgcgaccggccugcggaacagcccgcagcgcgagcggcgccggaagcgcggccuguucggggccaucgccggcuucaucgagggcggguggcaggggaugguggacggcugguacggcuaccaccacuccaacgagcaggggucgggcuacgccgccgacaaggaguccacccagaaggcgaucgacggggucacgaacaaggugaacucgaucaucgacaagaugaacacccaguucgaggccgugggccgggaguucaacaaccucgagcgccggaucgagaaccugaacaagaagauggaggacggguuccuggacgucuggaccuacaacgccgagcuccuggugcugauggagaacgagcgcacccucgacuaccacgacuccaacgugcggaaccuguacgacaagguccgccugcagcucaaggacaacgccaaggagcugggcaacggcugcuucgaguucuaccacaagugcaacaacgagugcauggagagcgugcggaacgggacguacgacuacccccaguacuccgaggaggcccgccugaagcgggaggagaucucgggcgucaagcucgaguccaucgggaucuaccagauccugucgaucuacuccaccguggcgagcucccuggugcucgccaucaugauggccggccugucgcuguggaugugcuccaacgggagccuccagugccgcaucugcaucuga

SEQ ID NO: 10592 - RNA, 1683 nt, Artificial Sequence; identical to SEQ ID NO: 10482
  derived and/or modified CDS sequence (AUadapt) from InfluenzaA__AGR33888__HA

SEQ ID NO: 10593 - RNA, 1683 nt, Artificial Sequence; identical to SEQ ID NO: 10482
  derived and/or modified CDS sequence (AUadapt) from InfluenzaA__AGR33889__HA

SEQ ID NO: 10594 - RNA, 1683 nt, Artificial Sequence
  derived and/or modified CDS sequence (AUadapt) from InfluenzaA__AGR33890__HA
augaauacccaaauccugguguucgcccucaucgccaucacccccacgaacagcgacaagaucugccugggccaccacgcggucuccaaugggaccaaggugaacacccugaccgagcgcggcguggaggucgugaacgccacggagaccguggagcggaccagcaucccgcgcaucugcuccaaggggaagcggaccgucgaccucggccagugcgggcugcugggcacgaucaccggcccgccccagugcgaccaguuucucgaguucagcgccgaccugaucaucgagcgccgggagggguccgacgugugcuaccccggcaaguucgugaacgaggaggcccugcgccagauccuccgggagagugggggcaucgacaaggaggccaugggguucaccuacuccggcauccgcaccaacggcgcgacgagcgccugccggcgcuccgggagcuccuucuaugccgaaaugaaguggcugcugagcaacaccgacaacgccgcguucccgcccaugaccaaguccuacaagaacacccggaaggcccccgcccucaucaucuggggcauccaccauagcgucuccacggccgagcagaccaagcuguacgggagcggcaacaagcuggugaccgugcgcuccagcaacuaccagcaguccuuuguccccagccccggcgccgggccccaggugaacggccagagcgggcggaucgacuuccacuggcucaugcugaaccccaacgauaccgugacguucuccuucaacggcgcguucaucgcccccgaccgcgccagcuuccugcgggggaaguccaugggcauccagagcggcguccagguggaugccaacugcgagggggacugcuaccacuccggcgggaccaucaucagcaaccucccguuucagaacaucgacucccgcguggucggcaagugcccccgguacgugaagcagaagucccugcugcucgccaccgggaugaaaaacgugcccgagauccccaagggccgcggccuguucggggcgaucgccggcuucaucgagaacgggugggagggccugaucgaugggugguacggcuuccggcaccagaacgcccagggcgaggggaccgccgccgacuacaagagcacgcagagcgcgaucaaucagaugaccggcaagcucaaccgccugaucgagaagaccaaccagcaguucgagcugaucgacaacgaguucaccgaggucgagaagcagaucgggaacgugaucaauuggacgcgggacuccaucaccgaaguguggagcuacaacgccgagcuccuggucgccauggagaaccagcacaccaucgaccuggccgacuccgagaugaauaagcucuacgagcgcgugaagcgccagcugcgggagaacgccgaggaggacggcaccggcugcuucgagaucuuccacaagugcgaugacgacugcauggcgagcauccgcaacaacacguacgaccauuccaaguaccgggaggaggccaugcagaaccgcauccagaucgacccggucaagcugagcuccggguacaaggacgugauccucugguucagcuuuggcgccuccugcuucauccugcuggccaucgcgauggggcucguguucaucugcgucaagaacggcaacaugcggugcaccaucugcaucuga

SEQ ID NO: 10595 - RNA, 1683 nt, Artificial Sequence
  derived and/or modified CDS sequence (AUadapt) from InfluenzaA__AGR33892__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccuccaucccgcgcaucugcagcaaggggaagcggaccgucgaccucggccagugcgggcugcugggcaccaucacgggcccgccccagugcgaucaguuccucgaguucuccgccgaccugaucaucgagcgccgggaggggagcgacgugugcuaccccggcaaguucgugaaugaggaggcccugcgccagauccuccgggaguccgggggcaucaacaaggaggcgaugggguucaccuacagcggcauccgcaccaacggcgccaccuccgccugccggcgcagcggguccaguuucuacgccgagaugaaguggcugcuguccaacacggacaacgcggccuucccgcccaugaccaagagcuauaagaacacccggaaggcccccgcccucaucaucuggggcauccaccacuccgggagcaccgccgagcagacgaaacuguacggcuccggcaacaagauggucaccgugcgcagcuccaacuaucagcagagcuucgugcccucccccggggcgggcccccaggucaacgggcagagcggccggaucgacuuccacuggcugaugcucaaucccaacgacaccgugaccuucagcuucaacggggccuucaucgcccccgaucgcgccuccuuccugcggggcaagagcaugggcauccaguccggggugcaggucgacgccaacugcgagggcgacugcuaccauagcgggggcacgaucaucuccaaccugccguuccagaacaucgacagccgcgugguggggaagugcccccgguaugucaagcagaagucccuccugcuggcgaccggcaugaagaacgugcccgagauccccaagggccgcggccucuucggggccaucgccggguucaucgagaacggcugggaggggcugaucgacggcugguacggcuuccggcaucagaacgcccagggggagggcaccgccgcggacuacaagagcacccaguccgccaucaaccagaugacggggaagcugaaccgccucaucgagaagaccaaccagcaauucgagcugaucgauaacgaguucaccgagguggagaagcagaucggcaacgucaucaacuggacccgggacagcaucacggaggugugguccuacaaugccgagcugcucguggccauggagaaccagcacaccaucgaccuggccgacagcgagaugaacaagcuguacgagcgcgucaagcgccagcuccgggagaaugcggaggaggacggcaccgggugcuucgagaucuuccacaagugcgacgacgauugcauggccuccauccgcaacaacaccuacgaccacagcaaguaucgggaggaggccaugcagaaccgcauccagaucgacccggugaagcuguccagcggcuacaaggacgucauccugugguucuccuucggggccaguugcuucauccuccuggcgaucgccaugggccugguguucaucugcguggagaacgggaacaugcggugcacgaucugcaucuga

SEQ ID NO: 10596 - RNA, 1683 nt, Artificial Sequence; identical to SEQ ID NO: 10474
  derived and/or modified CDS sequence (AUadapt) from InfluenzaA__AGR33895__HA

SEQ ID NO: 10597 - RNA, 1683 nt, Artificial Sequence; identical to SEQ ID NO: 10553
  derived and/or modified CDS sequence (AUadapt) from InfluenzaA__AGR33897__HA

SEQ ID NO: 10598 - RNA, 1683 nt, Artificial Sequence
  derived and/or modified CDS sequence (AUadapt) from InfluenzaA__AGR33899__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcagccuguucuccucggcccgguccuaccagcgcauccagaucuucccggacaccaucuggaacgugucguacaacgggaccuccaaggccugcucgggcuccuucuaccggucgaugcgcuggcugacccagaagaacuccaacuaccccauccaggacgcgcaguacaccaacaaccaggggaagaacauccucuucauguggggcaucaaccacccgcccaccgacacgacccagcgggaccuguacacccgcaccgacacgaccaccagcgucgccaccgaggagaucaaccggaucuucaagccccugaucgggccccgcccccucgugaacggccugaugggccggaucgacuacuacugguccgugcugaagcccgggcagacgcuccgcaucaagucggacggcaaccugaucgccccgugguacgggcacauccugucgggcgagucccacggccggauccucaagaccgaccugaagaaggggucgugcaccguccagugccagaccgagaagggcgggcugaacacgacccuccccuuccagaacguguccaaguacgccuucggcaacugcagcaaguacaucgggaucaagucccugaagcuggcggugggccuccgcaacguccccucgcgguccucgcgcggccuguucggggccaucgccggcuucaucgagggcgggugguccgggcugguggccggcugguacggcuuccagcacucgaacgaccagggggugggcauggccgcggaccgggacuccacccagaaggccaucgacaagaucaccucgaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggagcaacgccgucgaggacggcaaggggugcuucgagcuguaccacaagugcgacgaccagugcauggagaccauccgcaacggcaccuacaaccgguccaaguaccaggaggagucgaagcucgagcgccagaagaucgagggcgugaagcuggaguccgaggggacguacaagauccugaccaucuacucgaccgucgccuccucgcucgugaucgccaugggcuucgccgcguuccuguucugggccaugagcaacggguccugccgcugcaacaucugcaucuga

SEQ ID NO: 10599 - RNA, 1683 nt, Artificial Sequence
  derived and/or modified CDS sequence (AUadapt) from InfluenzaA__AGR33900__HA
auggagaccgugucgcugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgucaacggccugugcuaccccggcaacguggagaaccuggaggagcuccgcucgcuguucuccagcgcccgguccuaccagcgcauccagaucuucccggacaccaucuggaacgugucguacaacgggaccuccaaggccugcucgggcuccuucuaccggucgaugcgcuggcugacccagaagaacuccgacuaccccauccaggacgcgcaguacaccaacaaccaggggaagaacauccucuucauguggggcaucaaccacccgcccaccgacacgacccagcgggaccuguacacccgcaccgacacgaccaccucggucgccaccgaggagaucaaccggaucuucaagccccugaucgggccccgcccccucgugaacggccugaugggccggaucgacuacuacugguccgugcugaagcccgggcagacgcuccgcaucaagucggacggcaaccugaucgccccgugguacgggcacauccugagcggcgagucccacggccggauccucaagaccgaccugaagaaggggucgugcaccguccagugccagaccgagaagggcgggcugaacacgacccuccccuuccagaacguguccaaguacgccuucggcaacugcucgaaguacaucgggaucaagucccugaagcuggcggugggccuccgcaacguccccucgcgguccucgcgcggccuguucggggccaucgccggcuucaucgagggcgggugguccgggcugguggccggcugguacggcuuccagcacucgaacgaccagggggugggcauggccgcggaccgggacuccacccagaaggccaucgacaagaucaccagcaaggucaacaacaucguggacaagaugaacaagcaguacgagaucaucgaccacgaguucuccgagguggagacgcgccucaacaugaucaacaacaagaucgacgaccagauccaggacaucugggccuacaacgccgagcugcugguccuccuggagaaccagaagacccuggacgagcacgacgccaacgugaacaaccucuacaacaaggugaagcgggcgcuggggucgaacgccgucgaggacggcaaggggugcuucgaccuguaccacaagugcgacgaccagugcauggagaccauccgcaacggcaccuacaaccggcgcaaguaccaggaggaguccaagcucgagcgccagaagaucgagggcgugaagcuggagucggaggggacguacaagauccugaccaucuacuccaccgucgccucgucccucgugaucgccaugggcuucgccgcguuccuguucugggccaugucgaacgggagcugccggugcaacaucugcaucuga

SEQ ID NO: 10600 - RNA, 1683 nt, Artificial Sequence
  derived and/or modified CDS sequence (AUadapt) from InfluenzaA__AGR33902__HA
auggagaccgccucgcugaucaccauccuccugguggccacggucuccaacgcggacaagaucugcaucggcuaccagucgaccaacuccaccgagaccguggacacgcugaccgagaacaacgugcccgucacccacgccaaggagcuccugcacaccgagcacaacgggaugcugugcgccacgucgcucggccagccgcugauccuggacacgugcaccaucgaggggcucaucuacggcaaccccuccugcgaccugcugcucgaggggcgcgaguggucguacaucguggagcggcccuccgccgugaacggccugugcuaccccggcaacgucgagaaccuggaggagcuccgcucgcuguucuccucggcccgguccuaccagcgcauccagaucuucccggacaccaccuggaacgugucguacaacgggaucuccaaggcgugcagcggcuccuucuaccggucgaugcgcuggcugacccagaagaacuccaacuaccccauccaggacgcccaguacaccaacaaccaggggaagaacauccucuucauguggggcaucaaccacccgcccaccgacacgacccagcgggaccuguacacccgcaccgacacgaccaccucgguggccaccgaggagaucaaccggaucuucaagccccugaucgggccccgcccccucgucaacggccugaugggccggaucgacuacuacugguccgugcugaagcccgggcagacgcuccgcaucaagucggacggcaaccugaucgccccgugguacgggcacauccugucgggcgagucccacggccggauccucaagaccgaccugaagcgcgggucgugcaccgugcagugccagaccgagaagggcgggcugaacacgacccuccccuuccagaacgucuccaaguacgcguucggcaacugcucgaaguacaucgggaucaagucccugaagcuggccgugggccuccggaacgugcccucgcgcuccagccggggccuguucggggccaucgccggcuucaucgagggcgggugguccgggcuggucgccggcugguacggcuuccagcacucgaacgaccagggggugggcauggcggccgaccgcgacuccacccagaaggccaucgacaagaucaccucgaaggugaacaacaucgucgacaagaugaacaagcaguacgagaucaucgaccacgaguucuccgagguggagacgcggcucaacaugaucaacaacaagaucgacgaccagauccaggacaucugggccuacaacgccgagcugcuggugcuccuggagaaccagaagacccuggacgagcacgacgcgaacgucaacaaccucuacaacaaggugaagcgcgcccuggggucgaacgccguggaggacggcaaggggugcuucgagcuguaccacaagugcgacaaccagugcauggagaccauccggaacggcaccuacaaccgccgcaaguaccaggaggaguccaagcucgagcggcagaagaucgagggcgucaagcuggagucggaggggacguacaagauccugaccaucuacuccaccguggccucgucccucgucaucgccaugggcuucgcggccuuccuguucugggccaugucgaacgggagcugccgcugcaacaucugcaucuga

SEQ ID NO: 10601 - RNA, 1698 nt, Artificial Sequence; identical to SEQ ID NO: 5758
  derived and/or modified CDS sequence (AUadapt) from InfluenzaA__AGR49817__HA

SEQ ID NO: 10602 - RNA, 1698 nt, Artificial Sequence
  derived and/or modified CDS sequence (AUadapt) from InfluenzaA__AGR49841__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagccccgcgacaccaucaucuucgaggccaacggcaaccugaucgcgccgcgguacgccuucgcccucucccgcggguucggcagcgggaucaucaacuccaacgcccccaugggcaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgaguccaucggcguguaccagauccuggcgaucuacagcaccguggccagcucccugguccuccuggugagccugggcgccaucuccuucuggaugugcagcaacgggucccuccagugccggaucugcaucuga

SEQ ID NO: 10603 - RNA, 1698 nt, Artificial Sequence; identical to SEQ ID NO: 5758
  derived and/or modified CDS sequence (AUadapt) from InfluenzaA__AGR49853__HA

SEQ ID NO: 10604 - RNA, 1698 nt, Artificial Sequence
  derived and/or modified CDS sequence (AUadapt) from InfluenzaA__AGR49865__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucucguccgugagcuccuucgagcgguucgagaucuucccgaaggagagcuccuggcccaaccacacggucaccggggugucggccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccaacaucgugaaccagaagacccuguaccggacggagaacgccuacgucuccguggugucgagccacuacucccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucaaccggggcuucgggagcggcaucaucaacuccaacgcccccauggacaagugcgacgccaagugccagacgccccagggcgcgaucaacucgucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacguguggacguacaacgccgagcugcugguccuccuggagaacgagcgcacccuggacuuccacgacucgaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgggagaagaucgacggggugaagcucgaguccaugggcguguaccagauccuggcgaucuacucgaccgucgccuccagccuggugcuccuggugagccugggcgccaucuccuucuggaugugcagcaacgggucccuccagugccgcaucugcaucuga

SEQ ID NO: 10605 - RNA, 1701 nt, Artificial Sequence; identical to SEQ ID NO: 62
  derived and/or modified CDS sequence (AUadapt) from InfluenzaA__AGR49877__HA

SEQ ID NO: 10606 - RNA, 1701 nt, Artificial Sequence; identical to SEQ ID NO: 2679
  derived and/or modified CDS sequence (AUadapt) from InfluenzaA__AGR49888__HA

SEQ ID NO: 10607 - RNA, 1701 nt, Artificial Sequence
  derived and/or modified CDS sequence (AUadapt) from InfluenzaA__AGR49900__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaagugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 10608 - RNA, 1701 nt, Artificial Sequence
  derived and/or modified CDS sequence (AUadapt) from InfluenzaA__AGR49912__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggucggacgcccccaucgggaagugcaacuccaagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 10609 - RNA, 1701 nt, Artificial Sequence
  derived and/or modified CDS sequence (AUadapt) from InfluenzaA__AGR49924__HA
augaagaccaucaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggucggacgcccccaucgggaagugcaacuccaagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccgucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 10610 - RNA, 1701 nt, Artificial Sequence
  derived and/or modified CDS sequence (AUadapt) from InfluenzaA__AGR49936__HA
augaagaccaucaucgcccugucguacauccucugccugaucuccgcccagaaguuccccggcaacgacaacucgaccgcgacgcugugccucgggcaccacgccgugccgaacggcaccaucgucaagaccaucaccaacgaccagaucgaggugacgaacgccaccgagcuggugcaguccagcuccaccggggagaucugcgacucgccccaccagauccuggacggcgagaacugcacccucaucgacgcccugcugggggacccccagugcgacggcuuccagaacaagaagugggaccucuucgucgagcgcuccaaggccuacagcaacugcuaccccuacgacgugccgggcuacgcgucccugcggucgcugguggccuccagcgggacgcucgaguucaacaacgaguccuucaacuggaccggcgucacccagaacgggaccucguccgccugcauccgccggagcaacaacuccuucuucucgcgccugaacuggcugacgcaccucaaguucaaguaccccgcccugaacgugaccaugcccaacaacgaggaguucgacaagcuguacaucuggggcgugcaccaccccgggaccgacaacgaccagaucuuccucuacgcgcaggccuccggccggaucaccgucagcacgaagcgcucgcagcagaccgugaucccgaacaucggcucccggccccgcgugcggaacauccccagccgcaucuccaucuacuggaccaucgucaagcccggggacauccugcugaucaacucgaccggcaaccucaucgccccgcggggguacuucaagauccgcuccggcaagagcuccaucaugcggucggacgcccccaucggcaagugcaacuccgagugcaucacgcccaacgggagcauccccaacgacaagccguuccagaacgugaaccgcaucaccuacggcgccugcccccgguacgugaagcagaacacccugaagcuggcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccucaagucgacccaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacaugggcaacgggugcuucaagaucuaccacaagugcgacaacgcgugcaucggcucgauccgcaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 10611 - RNA, 1701 nt, Artificial Sequence; identical to SEQ ID NO: 7939
  derived and/or modified CDS sequence (AUadapt) from InfluenzaA__AGR49948__HA

SEQ ID NO: 10612 - RNA, 1701 nt, Artificial Sequence; identical to SEQ ID NO: 2772
  derived and/or modified CDS sequence (AUadapt) from InfluenzaA__AGR49960__HA

SEQ ID NO: 10613 - RNA, 1701 nt, Artificial Sequence
  derived and/or modified CDS sequence (AUadapt) from InfluenzaA__AGR49972__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgaucguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 10614 - RNA, 1698 nt, Artificial Sequence; identical to SEQ ID NO: 6943
  derived and/or modified CDS sequence (AUadapt) from InfluenzaA__AGR49983__HA

SEQ ID NO: 10615 - RNA, 1698 nt, Artificial Sequence; identical to SEQ ID NO: 6943
  derived and/or modified CDS sequence (AUadapt) from InfluenzaA__AGR49995__HA

SEQ ID NO: 10616 - RNA, 1701 nt, Artificial Sequence; identical to SEQ ID NO: 62
  derived and/or modified CDS sequence (AUadapt) from InfluenzaA__AGR50007__HA

SEQ ID NO: 10617 - RNA, 1701 nt, Artificial Sequence; identical to SEQ ID NO: 62
  derived and/or modified CDS sequence (AUadapt) from InfluenzaA__AGR50018__HA

SEQ ID NO: 10618 - RNA, 1701 nt, Artificial Sequence; identical to SEQ ID NO: 62
  derived and/or modified CDS sequence (AUadapt) from InfluenzaA__AGR50029__HA

SEQ ID NO: 10619 - RNA, 1701 nt, Artificial Sequence
  derived and/or modified CDS sequence (AUadapt) from InfluenzaA__AGR50040__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaugggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 10620 - RNA, 1701 nt, Artificial Sequence; identical to SEQ ID NO: 62
  derived and/or modified CDS sequence (AUadapt) from InfluenzaA__AGR50052__HA

SEQ ID NO: 10621 - RNA, 1701 nt, Artificial Sequence; identical to SEQ ID NO: 62
  derived and/or modified CDS sequence (AUadapt) from InfluenzaA__AGR50063__HA

SEQ ID NO: 10622 - RNA, 1701 nt, Artificial Sequence
  derived and/or modified CDS sequence (AUadapt) from InfluenzaA__AGR50074__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccggaaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 10623 - RNA, 1701 nt, Artificial Sequence; identical to SEQ ID NO: 62
  derived and/or modified CDS sequence (AUadapt) from InfluenzaA__AGR50085__HA

SEQ ID NO: 10624 - RNA, 1701 nt, Artificial Sequence; identical to SEQ ID NO: 62
  derived and/or modified CDS sequence (AUadapt) from InfluenzaA__AGR50096__HA

SEQ ID NO: 10625 - RNA, 1701 nt, Artificial Sequence; identical to SEQ ID NO: 62
  derived and/or modified CDS sequence (AUadapt) from InfluenzaA__AGR50107__HA

SEQ ID NO: 10626 - RNA, 1701 nt, Artificial Sequence; identical to SEQ ID NO: 96
  derived and/or modified CDS sequence (AUadapt) from InfluenzaA__AGR50118__HA

SEQ ID NO: 10627 - RNA, 1701 nt, Artificial Sequence
  derived and/or modified CDS sequence (AUadapt) from InfluenzaA__AGR50129__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggcagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 10628 - RNA, 1701 nt, Artificial Sequence; identical to SEQ ID NO: 62
  derived and/or modified CDS sequence (AUadapt) from InfluenzaA__AGR50140__HA

SEQ ID NO: 10629 - RNA, 1701 nt, Artificial Sequence; identical to SEQ ID NO: 3096
  derived and/or modified CDS sequence (AUadapt) from InfluenzaA__AGR50151__HA

SEQ ID NO: 10630 - RNA, 1698 nt, Artificial Sequence; identical to SEQ ID NO: 6943
  derived and/or modified CDS sequence (AUadapt) from InfluenzaA__AGR50162__HA

SEQ ID NO: 10631 - RNA, 1701 nt, Artificial Sequence; identical to SEQ ID NO: 62
  derived and/or modified CDS sequence (AUadapt) from InfluenzaA__AGR50174__HA

SEQ ID NO: 10632 - RNA, 1701 nt, Artificial Sequence; identical to SEQ ID NO: 2940
  derived and/or modified CDS sequence (AUadapt) from InfluenzaA__AGR50185__HA

SEQ ID NO: 10633 - RNA, 1701 nt, Artificial Sequence; identical to SEQ ID NO: 62
  derived and/or modified CDS sequence (AUadapt) from InfluenzaA__AGR50196__HA

SEQ ID NO: 10634 - RNA, 1701 nt, Artificial Sequence
  derived and/or modified CDS sequence (AUadapt) from InfluenzaA__AGR50207__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaagggcaagagcuaccccaagcuguccaagucguacaucaacgacaaggggaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 10635 - RNA, 1701 nt, Artificial Sequence; identical to SEQ ID NO: 62
  derived and/or modified CDS sequence (AUadapt) from InfluenzaA__AGR50218__HA

SEQ ID NO: 10636 - RNA, 1701 nt, Artificial Sequence; identical to SEQ ID NO: 62
  derived and/or modified CDS sequence (AUadapt) from InfluenzaA__AGR50229__HA

SEQ ID NO: 10637 - RNA, 1701 nt, Artificial Sequence; identical to SEQ ID NO: 3096
  derived and/or modified CDS sequence (AUadapt) from InfluenzaA__AGR50240__HA

SEQ ID NO: 10638 - RNA, 1701 nt, Artificial Sequence; identical to SEQ ID NO: 2954
  derived and/or modified CDS sequence (AUadapt) from InfluenzaA__AGR50251__HA

SEQ ID NO: 10639 - RNA, 1701 nt, Artificial Sequence
  derived and/or modified CDS sequence (AUadapt) from InfluenzaA__AGR50262__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagaagacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 10640 - RNA, 1701 nt, Artificial Sequence; identical to SEQ ID NO: 62
  derived and/or modified CDS sequence (AUadapt) from InfluenzaA__AGR50273__HA

SEQ ID NO: 10641 - RNA, 1701 nt, Artificial Sequence
  derived and/or modified CDS sequence (AUadapt) from InfluenzaA__AGR50284__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacucgcccgugcacgacugcaacaccacgugccagaccccgaagggcgccaucaacaccucccugcccuuccagaacauccaccccaucaccaucgggaagugccccaaguacgucaagagcacgaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 10642 - RNA, 1701 nt, Artificial Sequence; identical to SEQ ID NO: 3644
  derived and/or modified CDS sequence (AUadapt) from InfluenzaA__AGR50295__HA

SEQ ID NO: 10643 - RNA, 1701 nt, Artificial Sequence; identical to SEQ ID NO: 62
  derived and/or modified CDS sequence (AUadapt) from InfluenzaA__AGR50306__HA

SEQ ID NO: 10644 - RNA, 1701 nt, Artificial Sequence; identical to SEQ ID NO: 62
  derived and/or modified CDS sequence (AUadapt) from InfluenzaA__AGR50317__HA

SEQ ID NO: 10645 - RNA, 1701 nt, Artificial Sequence; identical to SEQ ID NO: 10634
  derived and/or modified CDS sequence (AUadapt) from InfluenzaA__AGR50328__HA

SEQ ID NO: 10646 - RNA, 1701 nt, Artificial Sequence
  derived and/or modified CDS sequence (AUadapt) from InfluenzaA__AGR50339__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagagccuguaccagaacgccgacgccuacguguucgugggcuccucgcgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccucgaagggcgccaucaacaccucccugccguuccagaacauccaccccaucacgaucgggaagugccccaaguacgucaagagcaccaagcugcggcucgcgaccggccugcgcaacgugcccuccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacagcaccgucgccuccucgcuggugcucguggucucccugggggccaucagcuucuggaugugcuccaacggcagccugcagugccggaucugcaucuga

SEQ ID NO: 10647 - RNA, 1701 nt, Artificial Sequence
  derived and/or modified CDS sequence (AUadapt) from InfluenzaA__AGR50350__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggaucauggggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggggaacagcuaccccaagcucuccaagucguacaucaacgacaagggcaaggaggugcugguccugugggggauccaccaccccagcaccuccgccgaccagcagucgcucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 10648 - RNA, 1698 nt, Artificial Sequence
  derived and/or modified CDS sequence (AUadapt) from InfluenzaA__AGR50361__HA
augaaggugcagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 10649 - RNA, 1701 nt, Artificial Sequence
  derived and/or modified CDS sequence (AUadapt) from InfluenzaA__AGT18718__HA
augaaggugauccuggucgugcuccuguacaccuucgccaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgucagcuccuucgagcgcuucgagaucuuccccaagaccucguccuggcccaaccacgacagcaacaagggggugaccgccgccugcccgcacgccggcgccaaguccuucuacaagaaccugaucuggcucgugaagaaggggaacucguaccccaagcuguccaagagcuacaucaacgacaagggcaaggagguccuggugcucugggggauccaccaccccucgaccacggcggaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugaucgagcccggggacaagaucaccuucgaggccacgggcaaccucguggucccccgguacgcguucgccauggagcgcaacgccgggagcggcaucaucaucuccgacacccccgugcacgacugcaacacgaccugccagaccccggagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 10650 - RNA, 1701 nt, Artificial Sequence
  derived and/or modified CDS sequence (AUadapt) from InfluenzaA__AGT18720__HA
augaaggugauccuggucgugcuccuguacaccuucgccaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgucagcuccuucgagcgcuucgagaucuuccccaaggccucguccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccaacaccaccgccgaccagcagagccuguaccagaacgccgacgccuacguguucgucggcacgucccgguacucgaagaaguucaagcccgagaucgccauccgcccgaaggugcgggaccaggagcgccggaugaacuacuacuggacccugaucgagcccggcgacaagaucaccuucgaggcgaccgggaaccucguggucccccgcuacgccuucgccauggagcggaacgccggcuccgggaucaucaucagcgacacgcccgugcacgacugcaacacgaccugccagaccccggagggcgccaucaacaccucccugcccuuccagaacauccaccccaucaccaucggcaagugccccaaguacgucaagucgaccaagcugcgccucgcgaccgggcugcggaacgugccguccauccagucgcgcggccuguucggggccaucgccggcuucaucgagggcggguggacgggcaugguggacgggugguacggcuaccaccaccagaacgagcagggguccggcuacgccgccgaccucaagagcacccagaacgcgaucgacaagaucaccaacaaggugaacuccgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacucgaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgagaagaucgacggggugaagcucgaguccacccggaucuaccagauccuggcgaucuacucgaccgucgccuccagccuggugcucguggucucccugggcgccaucucguucuggaugugcagcaacgggucccugcagugccgcaucugcaucuga

SEQ ID NO: 10651 - RNA, 1701 nt, Artificial Sequence
  derived and/or modified CDS sequence (AUadapt) from InfluenzaA__AGT18721__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgucguccuggagcuacaucguggagaccuccucguccgacaacggcacgugcuaccccggcgacuucaucaacuacgaggagcuccgggagcagcugucguccgugagcuccauccagcgcucggagaucugcaccaagaccuccucguggcccaaccacgacuccaacaagggggucaccgccgccugcccccacgccggcgccaagucguucuacaagaaccugaucuggcucgugaagaaggggaacuccuacccgaagcugagcaagucguacaucaacgacaagggcaaggaggugcugguccucugggggauccaccaccagaacucccggggccaccagcagucgcuguaccagaacgccgacgccuacguguucgugggcacgucccgcuacagcaagaaguucaagcccgagaucgccauccggcccaaggucaaggagcaggacgggcgcauggacuacuacuggacccugaucgagcccggcgacaagaucaccuucgaggccaccgggaaccucguggugccgcgguacgcguucgccauggagcgcaacgccggcuccggcaucaucaucucggacacgcccguccacgacugcaacacgaccugccagacccccgagggggccaucaacaccucccugcccuuccagaacauccacccgaucaccaucggcaagugccccaaguacgucaagucgaccaagcugcggcucgccaccgggcugcgcaacgugcccuccauccagucgcggggccuguucggggcgaucgccggcuucaucgagggcggguggacgggcaugguggacgggugguacggcuaccaccaccagaacgagcagggguccggcuacgccgccgaccucaagagcacccagaacgccaucgacaagaucaccaacaaggugaacuccgugaucgagaagaugaacacccaguucacggcggucggcaaggaguucaaccaccuggagaagcgcaucgagaaccugaacaagaagguggacgacggguuccucgacaucuggaccuacaacgccgagcugcugguccuccuggagaacgagcggacccuggacuaccacgacucgaacgugaagaaccucuacgagaaggugcgcaaccagcugaagaacaacgccaaggagaucggcaacgggugcuucgaguucuaccacaagugcgacaacacgugcauggaguccgucaagaacggcaccuacgacuaccccaaguacucggaggaggccaagcugaaccgggagaagaucgacggggugaagcucgaguccacccgcaucuaccagauccuggccaucuacagcaccguggcguccucgcugguccucguggugucgcugggcgccaucuccuucuggaugugcagcaacggcucccugcagugccggaucugcaucuga

SEQ ID NO: 10652 - RNA, 1701 nt, Artificial Sequence
  derived and/or modified CDS sequence (AUadapt) from InfluenzaA__AGT18722__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaagucgaacaaccggacgugcuaccccggcgacuucaucaacuacgaggagcuccgcgagcagcuguccagcguguccucguucgagcgguucgagaucuuccccaagaccuccagcuggcccaaccacgacuccaacaagggcgucaccgccgccugcccgcacgccggggccaagucguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacgccuacguguucguggggaccucccgcuacagcaagaaguucaagcccgagaucgccauccggccgaagguccgcgaccaggagggccggaugaacuacuacuggacccugaucgagcccggcgacaagaucaccuucgaggcgacggggaaccucguggugccccgcuacgccuucgccauggagcggaacgccggcuccgggaucaucaucucggacacccccguccacgacugcaacacgaccugccagaccccggagggcgccaucaacaccucccugcccuuccagaacauccaccccaucaccaucggcaagugccccaaguacgucaagucgaccaagcugcgccucgcgacggggcugcggaacgugccguccauccagagccgcggccuguucggggccaucgccggcuucaucgagggcggguggaccggcaugguggacgggugguacggcuaccaccaccagaacgagcagggguccggcuacgccgccgaccucaagucgacccagaacgcgaucgacaagaucaccaacaaggugaacuccgugaucgagaagaugaacacgcaguucaccgccgucgggaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggaaccagcugaagaacaacgccaaggagaucggcaacgggugcuucgaguucuaccacaagugcgacaacacgugcauggaguccgucaagaacggcaccuacgacuaccccaaguacucggaggaggccaagcugaaccgcgagaagaucgacggggugaagcucgaguccacccggaucuaccagauccuggcgaucuacucgaccguggccuccagccugguccucguggugucccugggcgccaucucguucuggaugugcagcaacgggucccugcagugccgcaucugcaucuga

SEQ ID NO: 10653 - RNA, 1701 nt, Artificial Sequence
  derived and/or modified CDS sequence (AUadapt) from InfluenzaA__AGT18723__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccucguccuggucguacaucguggagaccuccaagacgaacaaccggaccugcuaccccggcgacuucaucaacuacgaggagcuccgcgagcagcugagcuccgugucguccuucgagcgguucgagaucuuccccaagaccucguccuggcccaaccacgacucgaacaagggcgucaccgccgccugcccgcacgccggggcgaaguccuucuacaagaaccugaucuggcucgugaagaagggcaacagcuaccccaagcuguccaagucguacaucaacgacaaggggaaggaggugcugguccucuggggcauccaccaccagaacaagaaggccgagcagcagacgcccuaccagaacgccgacgccuacguguucguggggaccucccgcuacucgaagaaguucaagcccgagaucgccauccggccgaagguccgcgaccaggagggccggauggacuacuacuggacccugaucgagcccggcgacaagaucaccuucgaggcgacggggaaccugguggugccccgcuacgccuucgccauggagcggaacgccggcucggggaucaucaucuccgacacccccguccacgacugcaacacgaccugccagaccccggagggcgccaucaacaccagccuccccuuccagaacauccaccccaucaccaucggcaagugccccaaguacgugaaguccaccaagcugcgccuggcgacggggcuccggaacgugccgucgauccagucccgcggccuguucggggccaucgccggcuucaucgagggcggguggaccggcauggucgacgggugguacggcuaccaccaccagaacgagcaggggucgggcuacgccgccgaccugaaguccacccagaacgcgaucgacaagaucaccaacaaggugaacucggugaucgagaagaugaacacgcaguucaccgccgucgggaaggaguucaaccaccucgagaagcggaucgagaaccugaacaagaagguggacgacggcuuccuggacaucuggaccuacaacgccgagcuccugguccugcucgagaacgagcgcacccuggacuaccacgacuccaacgugaagaaccuguacgagaaggugcggaaccagcucaagaacaacgccaaggagaucggcaacgggugcuucgaguucuaccacaagugcgacaacacgugcauggagagcgucaagaacggcaccuacgacuaccccaaguacuccgaggaggccaagcugaaccgcgagaagaucgacggggugaagcuggagucgacccggaucuaccagauccucgcgaucuacuccaccguggccucgucccugguccugguggugucgcucggcgccaucuccuucuggaugugcagcaacgggucccugcagugccgcaucugcaucuga

SEQ ID NO: 10654 - RNA, 1701 nt, Artificial Sequence
  derived and/or modified CDS sequence (AUadapt) from InfluenzaA__AGT18724__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagucgcuguccaccgccucguccuggagcuacaucguggagaccuccaagacgaacaaccggaccugcuaccccggcgacuucaucaacuacgaggagcuccgcgagcagcugucguccgucucguccuucgagcgguucgagaucuuccccaagaccagcuccuggcccaaccacgacucgaacaagggcgugaccgcggccugcccgcacgccggggccaaguccuucuacaagaaccugaucuggcucgugaagaagggcaacucguaccccaagcuguccaagagcuacaucaacgacaaggggaaggagguccuggugcucuggggcauccaccaccccuccacgaccgcggaccagcagacccuguaccagaacgccgacgccuacguguucgucgggaccucgcgcuacucgaagaaguucaagcccgagaucgccauccggccgaaggugcgcgaccaggagggccggaugaacuacuaccgcacgcugaucgagcccgagaacaagaucaccuucgaggccaccggcaaccucguggucccccgguacgcguucgccauggagcgcaacgccggguccggcaucaucaucagcgacacccccgugcacgacugcaacacgaccugccagaccccggagggggccaucaacaccucccugcccuuccagaacauccaccccaucacgaucggcaagugccccaaguacgucaagucgaccaagcugcggcucgccaccggccugcgcaacgugccguccauccagucgcgggggcuguucggcgcgaucgccggguucaucgagggcggguggaccggcaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacucgaacgugaagaaccucuacgagaagguccgcaaccagcugaagaacaacgccaaggagaucggcaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacagcaccgucgcguccucgcuggugcucguggucucccugggggccaucucguucuggaugugcuccaacggcagccugcagugccggaucugcaucuga

SEQ ID NO: 10655 - RNA, 1701 nt, Artificial Sequence
  derived and/or modified CDS sequence (AUadapt) from InfluenzaA__AGT18725__HA
augaaggugauccuggucgugcuccuguacaccuucgccaccgccaacgcggacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgucucguccuucgagcgcuucgagaucuuccccaagaccagcuccuggcccaaccacgacucgaacaagggggugaccgccgccugcccgcacgccggcgccaaguccuucuacaagaaccugaucuggcucgugaagaaggggaacagcuaccccaagcuguccaagucguacaucaacgacaagggcaaggagguccuggugcucugggggauccaccaccccagcaccuccgcggaccagcagucgcuguaccagaacgccgacgccuacguguucgucggcacgucccgguacagcaagaaguucaagcccgagaucgccauccgcccgaaggugcgggaccaggagggccgcaugaacuacuacuggacccugguggagcccggggacaagaucaccuucgaggccaccggcaaccucgucgugccccgguacgcguucgccauggagcgcaacgccggguccggcaucaucaucucggacacgcccgugcacgacugcaacacgaccugccagaccccggagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgcgaucgccggguucaucgagggcggcuggacggggaugguggacggcugguacggguaccaccaccagaacgagcagggcuccggguacgccgccgaccucaagagcacccagaacgccaucgacaagaucaccaacaaggucaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcacccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgucaagcucgaguccacccgcaucuaccagauccuggccaucuacucgaccguggcguccagccuggugcucgucgugucgcugggggccaucuccuucuggaugugcagcaacggcucccugcagugccggaucugcaucuga

SEQ ID NO: 10656 - RNA, 1701 nt, Artificial Sequence
  derived and/or modified CDS sequence (AUadapt) from InfluenzaA__AGT18734__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaucaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 10657 - RNA, 1701 nt, Artificial Sequence; identical to SEQ ID NO: 10368
  derived and/or modified CDS sequence (AUadapt) from InfluenzaA__AGT18735__HA

SEQ ID NO: 10658 - RNA, 1701 nt, Artificial Sequence
  derived and/or modified CDS sequence (AUadapt) from InfluenzaA__AGT18748__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacgaggagaacugcacccugaucgacgcccugcucggcgacccccagugcgacgacuuccagaacaagaagugggaccuguucguggagcgguccaaggccuacagcaacugcuaccccuacgacgugccggacuacgcgucccugcgcucgcucgucgccuccagcgggacccuggaguucaacaacgaguccuucaacugggccggcgugacgcagaacggcaccucguccgccugccggcgcgggagcaacuccucguucuucucccggcugaacuggcucacccaccugaacuucaaguaccccgcgcugaacgugaccaugcccaacaacgagcaguucgacaagcucuacaucuggggcguccaccaccccagcacggacaaggaccagaucuuccuguacgcccaguccucggggcgcaucaccgugagcaccaagcggucccagcaggccgugaucccgaacaucggcucgcgcccccggauccgcaacauccccucccggaucagcaucuacuggaccaucgucaagcccggggacauccugcucaucaacuccacgggcaaccugaucgccccgcgcggcuacuucaagauccggucggggaaguccagcaucaugcgcuccgacgcccccaucggcaagugcaagucggagugcaucacccccaacggguccauccccaacgacaagccguuccagaacgugaaccggaucaccuacggcgcgugcccccgcuacgugaagcagagcacccugaagcucgccacgggcaugcggaacguccccgagaagcagacccgcgggaucuucggcgccaucgccggguucaucgagaacggcugggaggggaugguggacggcugguacggcuuccggcaccagaacuccgaggggcgcggccaggccgcggaccucaagucgacccaggccgccaucgaccagaucaacgggaagcugaaccggcugaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacaugggcaacggcugcuucaagaucuaccacaagugcgacaacgccugcaucgggucgauccggaacggcacguacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggguucaucaugugggcgugccagaagggcaacauccgcugcaacaucugcaucuga

SEQ ID NO: 10659 - RNA, 1701 nt, Artificial Sequence
  derived and/or modified CDS sequence (AUadapt) from InfluenzaA__AGT18749__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccgacgaccagaucgaggugacgaacgccaccgagcugguccagaacucguccaccggcgagaucugcgacagcccccaccagauccucgacggggagaacugcacccugaucgacgcccugcucggcgacccccagugcgacggguuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggcgugacccagaacgggaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccggaucaccgugagcacgaagcgcucccagcaggccgugaucccgaacaucgggucgcggccccgcguccggaacauccccucgcgcaucuccaucuacuggaccaucgugaagcccggcgacauccugcucaucaacagcaccggcaaccugaucgccccgcggggguacuuccgcauccgguccggccgcucguccaucaugcggagcgacgcccccaucgggaagugcaacuccgagugcaucacccccaacggcucgauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacgggugggagggcaugguggacggcugguacggguuccgccaccagaacuccgagggccgggggcaggccgcggaccucaagucgacgcaggccgccaucgaccagaucaacggcaagcugaaccgccugaucgggaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgggagaacgcggaggacaugggcaacgggugcuucaagaucuaccacaagugcgacaacgccugcaucggcucgauccgcaacgggaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggcgugccagaagggcaacauccggugcaacaucugcaucuga

SEQ ID NO: 10660 - RNA, 1701 nt, Artificial Sequence
  derived and/or modified CDS sequence (AUadapt) from InfluenzaA__AGT18751__HA
augaagaccgugaucgcccugucguacauccucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgucccggacuacgcgucccugcggagccucguggccuccucgggcacgcuggaguucaacaacgaguccuucaacuggaccggggugacccagaacggcaccagcuccgccugcauccgccggucgaacaacuccuucuucucgcgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccuccgggcggaucaccgugagcacgaagcgcucccagcaggccgucaucccgaacaucggcucgcggccccgcgugcggaacauccccagccgcaucuccaucuacuggaccaucgugaagcccggcgacauccugcucaucaacucgaccgggaaccugaucgccccgcggggcuacuucaagauccgcuccgggcggagcuccaucaugcgcucggacgcccccaucggcaagugcaacuccgagugcaucacccccaacggcucgauccccaacgacaagccguuccagaacgucaaccggaucacguacggggcgugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggucguacaaguccgagcuccuggucgcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagucgggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 10661 - RNA, 1701 nt, Artificial Sequence
  derived and/or modified CDS sequence (AUadapt) from InfluenzaA__AGT18752__HA
augaagaccaucaucgcccugucguacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcaacagcccccaccagauccuggacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccagcuccgccugcauccgccggucgaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugucgacgaagcgcucccagcaggccgugaucccgaacaucggcagccggccccgcguccggaacauccccucgcgcaucuccaucuacuggaccaucgugaagcccggcgacauccugcugaucaacagcaccgggaaccucaucgccccgcggggcuacuucaagauccgcuccgggcggucguccaucaugcgcagcgacgcccccaucggcaagugcaacuccgagugcaucacccccaacggcucgauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggucguacuccagcgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 10662 - RNA, 1701 nt, Artificial Sequence
  derived and/or modified CDS sequence (AUadapt) from InfluenzaA__AGT18753__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcaacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccgggcggagcuccaucaugcgcucggacgcccccaucggcaagugcaacuccgagugcaucacccccaacggcucgauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaaguccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10663 - RNA, 1701 nt, Artificial Sequence
  derived and/or modified CDS sequence (AUadapt) from InfluenzaA__AGT18754__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccgacgaccagaucgaggugacgaacgccaccgagcugguccagaacucguccaccggcgagaucugcgacucgccccaccagauccucgacggggagaacugcacccugaucgacgcccugcucggcgacccccagugcgacggguuccagaacaagaagugggaccuguucguggagcgcggcaaggccuacuccaacugcuaccccuacgacgugccggacuacgcgagccugcggucccucgucgccacgucgggcacccuggaguucaacaacgaguccuucaacuggaccggggugacccagaacggcacgucguccgccugcauccgccggagcaacaacuccuucuucucgcgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucacggugucgaccaagcgcucccagcaggccgugaucccgaacaucggcagccggccccgcguccggaacauccccucccgcaucucgaucuacuggaccaucgugaagcccggcgacauccugcucaucaacucgaccgggaaccugaucgccccgcggggcuacuucaagauccgcuccgggcggagcuccaucaugcgcucggacgcccccaucggcaagugcaacuccgagugcaucacgcccaacggcucgauccccaacgacaagccguuccagaacgugaaccggaucaccuacggggcgugcccccgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 10664 - RNA, 1701 nt, Artificial Sequence
  derived and/or modified CDS sequence (AUadapt) from InfluenzaA__AGT18756__HA
augaagaccaucaucgcccugucguacgugcucugccuggucuucgcccagaagcugcccggcaacgacaacuccaccgcgacgcucugccuggggcaccacgccgugccgaacggcaccaucgugaagaccaucaccaacgaccgcaucgaggucacgaacgccaccgagcuggugcagaacagcuccaucggggagaucugcgacucgccccaccagauccucgacggcgagaacugcacccugaucgacgcccugcucggggacccccagugcgacgacuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacugggccggcgugacgcagaacgggaccucguccgccugccggcgcggcagcaacuccucguucuucucccggcugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccgggcgcaucaccgugucgaccaagcggagccagcaggccgucaucccgaacaucggcucccgcccccggauccgcaacauccccucgcggaucuccaucuacuggaccaucgugaagcccggcgacauccugcucaucaacagcacggggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggcgugcccccgcuacgucaagcaguccacccugaagcucgccacgggcaugcggaacgugcccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucucggaggucgagggccgcauccaggaccuggagaaguacguggaggacacgaagaucgaccugugguccuacaagagcgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccggaacggcacguacgaccacgacgucuaccgcgacgaggcccucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 10665 - RNA, 1701 nt, Artificial Sequence
  derived and/or modified CDS sequence (AUadapt) from InfluenzaA__AGT18757__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggcgugacgcagaacgggaccucguccgccugccggcgcggcagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugucgaccaagcggagccagcaggccgugaucccgaacaucggcucccgcccccggauccgcaacauccccucgcggaucuccaucuacuggaccaucgucaagcccggcgacauccugcucaucaacagcacggggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucucggagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacauggggaacggcugcuucaagaucuaccacaagugcgacaacgccugcaucggguccauccggaacggcacguacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 10666 - RNA, 1701 nt, Artificial Sequence
  derived and/or modified CDS sequence (AUadapt) from InfluenzaA__AGT18758__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggcgugacgcagaacgggaccucguccgccugccggcgcggcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccgggcgcaucaccgugagcaccaagcggucgcagcaggccgugaucccgaacaucggcucccgcccccggauccgcaacauccccagccggaucuccaucuacuggaccaucgucaagcccggcgacauccugcucaucaacucgacggggaaccugaucgccccgcgcggcuacuucaagauccgguccggcaagagcuccaucaugcgcagcgacgcccccaucgggaagugcaaguccgagugcaucacccccaacggcucgauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucucggagguggagggccgcauccaggaccuggagaaguacgucgaggacacgaagaucgaccugugguccuacagcuccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacacgugcaucggguccauccggaacggcaccuacgaccacgacguguaccgcgacgaggcgcucaacaaccgguuccagaucaagggggucgagcucaagagcggcuacaaggacuggauccuguggaucagcuucgccaucuccugcuuccuggugugcguggcccugcugggcuucaucaugugggccugccagaaggggaacauccgcugcaacaucugcaucuga

SEQ ID NO: 10667 - RNA, 1701 nt, Artificial Sequence
  derived and/or modified CDS sequence (AUadapt) from InfluenzaA__AGT18759__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggcgugacgcagaacgggaccucguccgccugccggcgcggcagcaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccgggcgcaucaccgugagcaccaagcggucgcagcaggccgugaucccgaacaucggcucccgcccccggauccgcaacauccccagccggaucuccaucuacuggaccaucgucaagcccggcgacauccugcucaucaacucgacggggaaccugaucgccccgcgcggcuacuucaagauccgguccggcaagagcuccaucaugcgcagcgacgcccccaucgggaagugcaaguccgagugcaucacccccaacggcucgauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagaccaacgagaaguuccaccagaucgagaaggaguucucggagguggagggccgcauccaggaccuggagaaguacgucgaggacacgaagaucgaccugugguccuacagcuccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagagcggcuacaaggacuggauccuguggaucagcuucgccaucuccugcuuccuggugugcguggcccugcugggcuucaucaugugggccugccagaaggggaacauccgcugcaacaucugcaucuga

SEQ ID NO: 10668 - RNA, 1701 nt, Artificial Sequence
  derived and/or modified CDS sequence (AUadapt) from InfluenzaA__AGT18760__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacgacuuccagaacaagaagugggaccuguucguggagcggaacaaggccuacuccaacugcuaccccuacgacgugccggacuacgcgagccugcgcucccucgucgccucguccggcacccuggaguucaacaacgagagcuucaacugggccggcgugacgcagaacgggaccuccucggccugccggcgcggcuccaacagcuccuucuucucgcggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcgggcgcaucaccguguccaccaagcggucgcagcaggccgugaucccgaacaucggcagccgcccccggauccgcaacauccccucccggaucucgaucuacuggaccaucgucaagcccggcgacauccugcucaucaacuccacggggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggcgugcccccgcuacgugaagcagucgacccugaagcucgccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagagcacccaggccgccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggucguacaaguccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacguguaccgcgacgaggcccucaacaaccgguuccagaucaagggggucgagcucaagucgggcuacaaggacuggauccuguggaucuccuucgccaucagcugcuuccuggugugcguggcccugcugggcuucaucaugugggccugccagaaggggaacauccgcugcaacaucugcaucuga

SEQ ID NO: 10669 - RNA, 1701 nt, Artificial Sequence
  derived and/or modified CDS sequence (AUadapt) from InfluenzaA__AGT18761__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcagccucgucgccuccucgggcacccuggaguucaacaacgaguccuucaacugggccggcgugacgcagaacgggaccagcuccgccugccggcgcggcucgaacuccagcuucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugucgaccaagcggagccagcaggccgugaucccgaacaucggcucccgcccccggauccgcaacauccccucgcggaucuccaucuacuggaccaucgucaagcccggcgacauccugcucaucaacagcacggggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugguggacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacagcuccgaguuccucguggcccuggagaaccagcacaccaucgaccugaccgacucggagaugaacaagcuguucgagaagaccaagaagcagcuccgcgagaacgccgaggacauggggaacggcugcuucaagaucuaccacaagugcgacaacgcgugcaucggguccauccggaacggcacguacgaccacgacguguaccgcgacgaggcccugaacaaccgguuccagaucaagggggucgagcucaagagcggcuacaaggacuggauccuguggaucagcuucgccaucuccugcuuccuggugugcguggcccuccugggcuucaucaugugggccugccagaaggggaacauccgcugcaacaucugcaucuga

SEQ ID NO: 10670 - RNA, 1701 nt, Artificial Sequence
  derived and/or modified CDS sequence (AUadapt) from InfluenzaA__AGT37102__HA
auggaggccaagcuggugguccucuucugcgccuucaccacccugaaggcggacaucaucugcgugggcuaccacgccaacaacucgacggacaccguggacaccaucauggagaagaacgucaccgugacgcacuccgugaaccugcucgagaacagccacaacgggaagcugugcucccugaacggcaaggcgccccuccagcuggggaacugcaacgucgccggcuggauccuggggaacccggagugcgaccuccugcugaccgccaacagcugguccuacaucaucgagaccagcuccagcaagaacgggaccugcuaccccggcgaguucuccgacuacgaggagcuccgcgagcugcugucgacgguguccagcuucgagcgguucgagaucuuccccaaggccaccuccuggcccaaccacgagaccaccaagggggccacgaucgccugcagccacuccggcgccagcuccuucuaccgcaaccuccuguggaucgugaagaaggggaacagcuacccgaagaucuccaagucguacaccaacaaccggggcaaggagguccuggugaucuggggcgugcaccacccgcccaccgacagcucccagcaggcgcucuaccagaacacccacacguacaucagcgucggcuccagcaaguacuaccagcgcuucacccccgugguggccgcccggcccaagauccgcgagcaggagggccggaugaacuacuacuggacccugcuggagcagggggacaccaucacguucgaggccaccggcaaccucaucgcccccugguacgcguucgcccuggacaugggguccagcuccggcaucauggucucggacgcccccgugcacaacugcaccaccaagugccagacgccccacggcgcccugaaguccaaccucccguuccagaacgugcaccccaucaccaucggggagugccccaaguacgucaagagcacccagcugcgcauggccaccggccugcggaacauccccuccauccagagccgcggccucuucggggcgaucgccggguucaucgagggcggcuggacggggaugaucgacggcugguacggguaccaccaccagaacgagcagggcuccggguacgccgccgaccagaaguccacccagaucgccaucgacggcaucagcaacaaggugaacagcaucaucgagaagaugaacgugcaguucaccuccgucggcaaggaguucaacgaccuggagaagcggaucgagaaccugaacaagaagguggacgacggguuccucgacguguggaccuacaacgcggagcugcugguccuccuggagaacgagcgcacgcuggacuuccacgacuucaacgugaagaaccucuacgagaaggucaagucgcagcugcggaacaacgccaaggagaucggcaacgggugcuucgaguucuaccacaagugcgacaacgagugcauggagaacgugaagaacggcaccuacaacuacccgaaguacuccgaggagagcaagcugaaccgcgagaagaucgacggggugaagcucgagagcaucggcguccaccagauccuggccaucuacuccaccguggccagcucccuggugcuccuggucagccugggcgccaucuccuucuggaugugcagcaacgggucccuccagugccggaucugcaucuga

SEQ ID NO: 10671 - RNA, 1701 nt, Artificial Sequence
  derived and/or modified CDS sequence (AUadapt) from InfluenzaA__AGU01877__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacgaccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 10672 - RNA, 1701 nt, Artificial Sequence
  derived and/or modified CDS sequence (AUadapt) from InfluenzaA__AGU01878__HA
augaaggccauccugguggucaugcucuacacccuggccaccgcgaacgccgacacgcugugcaucggcuaccacgccaacaacucgaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagucgcuguccaccgccucguccuggagcuacaucguggagaccuccggcucggacaacggcacgugcuaccccggggacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggggcgaagggcuucuacaagaaccugaucuggcucgugaagaaggggaacucguaccccaagcuguccaucagcuacaucaacgacaagggcaaggaggugcugguccucuggggcauccaccaccccuccaccacggccgaccagcagucgcuguaccagaacgccgacaccuacguguucguggggaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccggcucggggaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggcuucaucgagggcggguggaccgggaugguggacggcugguacggguaccaccaccagaacgagcagggcucgggcuacgccgccgaccucaaguccacccagaacgccaucgacaagaucacgaacaaggugaacagcgucaucgagaagaugaacacccaguucaccgcgguggggaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagucgacccgcaucuaccagauccuggccaucuacuccaccgcggccagcucccugguccucguggugucgcugggcgccaucuccuucuggaugugcucgaacgggagccugcagugccggaucugcaucuga

SEQ ID NO: 10673 - RNA, 1701 nt, Artificial Sequence
  derived and/or modified CDS sequence (AUadapt) from InfluenzaA__AGU01879__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgagaagcugugcaagcuccgcggggucgcgccccugcaccugggcaagugcaacaucgccggguggauccucggcaacccggagugcgagucgcuguccaccgccagcuccuggucguacaucguggagaccuccgggucggacaacggcacgugcuaccccggcgacuucaucgacuacgaggagcugcgggagcagcucuccagcguguccucguucgagcgcuucgagaucuuccccaagaccuccucguggcccaaccacgacuccaacaagggggucaccgccgccugcccgcaggccggcgcgaagggguucuacaagaaccugaucuggcuggugaagaagggcaacagcuaccccaagcucuccaagucguacaucaacgacaaggggaaggaggugcugguccuguggggcauccaccaccccuccaccacggccgaccagcagucgcucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcucgggcaucaucaucuccgacacccccgugcacgacugcaacaccacgugccagaccccgaagggggccaucaacaccucgcuccccuuccagaacauccaccccaucaccaucggcaagugccccaaguacgugaaguccacgaagcugcggcuggccaccgggcuccgcaacgucccgagcauccagucccggggccuguucggggcgaucgccggcuucaucgagggcggguggaccggcaugguggacgggugguacggcuaccaccaccagaacgagcaggggucgggcuacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagucgacccgcaucuaccagauccucgccaucuacuccaccgucgcgucgucccuggugcugguggucagccucggcgccaucuccuucuggaugugcucgaacggcagccugcagugccggaucugcaucuga

SEQ ID NO: 10674 - RNA, 1701 nt, Artificial Sequence
  derived and/or modified CDS sequence (AUadapt) from InfluenzaA__AGU01881__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugucguccuucgagcgcuucgagauguuccccaagaccagcuccuggcccaaccacgacucgaacaagggcgucaccgcggccugcccgcaggccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 10675 - RNA, 1701 nt, Artificial Sequence
  derived and/or modified CDS sequence (AUadapt) from InfluenzaA__AGU01883__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcacgccggggcgaagggcuucuacaagaaccugaucuggcuggugaagaaggggaacagcuaccccaagcucuccaucucguacaucaacaacaaggagaaggaggugcugguccuguggggcauccaccaccccuccaccacggccgaccagcagucgcucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcucgggcaucaucaucuccgacacccccgugcacgacugcaacaccacgugccagaccccgaagggggccaucaacaccucgcuccccuuccagaacauccaccccaucaccaucggcaagugccccaaguacgugaaguccacgaagcugcggcuggccaccgggcuccgcaacgucccgagcauccagucccggggccuguucggggcgaucgccggcuucaucgagggcggguggaccggcaugguggacgggugguacggcuaccaccaccagaacgagcaggggucgggcuacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagucgacccgcaucuaccagauccucgccaucuacuccaccgcggccucgucccugguccugguggugagccucggcgccaucuccuucuggaugugcucgaacggcagccugcagugccggaucugcaucuga

SEQ ID NO: 10676 - RNA, 1701 nt, Artificial Sequence; identical to SEQ ID NO: 10305
  derived and/or modified CDS sequence (AUadapt) from InfluenzaA__AGU01884__HA

SEQ ID NO: 10677 - RNA, 1701 nt, Artificial Sequence
  derived and/or modified CDS sequence (AUadapt) from InfluenzaA__AGU01885__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgagaagcugugcaagcuccgcggggucgcgccccugcaccugggcaagugcaacaucgccggguggauccucggcaacccggagugcgagucgcuguccaccgccagcuccuggucguacaucguggagaccuccgggucggacaacggcacgugcuaccccggcgacuucaucgacuacgaggagcugcgggagcagcucuccagcguguccucguucgagcgcuucgagaucuuccccaagaccuccucguggcccaaccacgacuccaacaagggggucaccgccgccugcccgcaggccggcgcgaagggguucuacaagaaccugaucuggcuggugaagaagggcaacagcuaccccaagcucuccaagucguacaucaacgacaaggggaaggaggugcugguccuguggggcauccaccaccccuccaccacggccgaccagcagucgcucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcucgggcaucaucaucuccgacacccccgugcacgacugcaacaccacgugccagaccccgaagggggccaucaacaccucgcuccccuuccagaacgugcaccccaucaccaucggcaagugccccaaguacgucaaguccacgaagcugcggcuggccaccgggcuccgcaacgugccgagcauccagucccggggccuguucggggcgaucgccggcuucaucgagggcggguggaccggcaugguggacgggugguacggcuaccaccaccagaacgagcaggggucgggcuacgccgccgaccugaaguccacccagaacgccaucgacaagaucacgaacaaggucaacucggugaucgagaagaugaacacccaguucaccgcggucggcaaggaguucaaccaccucgagaagcgcaucgagaaccugaacaagaagguggacgacggguuccuggacaucuggaccuacaacgccgagcuccuggugcugcucgagaacgagcggacgcuggacuaccacgacuccaacgucaagaaccuguacgagaaggugcgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcuggagucgacccgcaucuaccagauccucgccaucuacuccaccguggcgucgucccuggugcuggucgugagccucggcgccaucuccuucuggaugugcucgaacggcagccugcagugccggaucugcaucuga

SEQ ID NO: 10678 - RNA, 1701 nt, Artificial Sequence
  derived and/or modified CDS sequence (AUadapt) from InfluenzaA__AGU01887__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccgucgagcgcaacgccgggucgggcaucaucaucuccgacacccccgugcacaacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 10679 - RNA, 1701 nt, Artificial Sequence
  derived and/or modified CDS sequence (AUadapt) from InfluenzaA__AGU01888__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcaggccggggcgaagggcuucuacaagaaccugaucuggcuggugaagaaggggaacagcuaccccaagcucuccaagucguacaucaacgacaagggcaaggaggugcugguccuguggggcauccaccaccccuccaccacggccgaccagcagucgcucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccgcuucaccgcgguggggaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagucgacccggaucuaccagauccucgccaucuacuccaccgucgcgucgucccuggugcugguggucagccucggcgccaucuccuucuggaugugcucgaacgggagccugcagugccgcaucugcaucuga

SEQ ID NO: 10680 - RNA, 1701 nt, Artificial Sequence; identical to SEQ ID NO: 10671
  derived and/or modified CDS sequence (AUadapt) from InfluenzaA__AGU01889__HA

SEQ ID NO: 10681 - RNA, 1701 nt, Artificial Sequence
  derived and/or modified CDS sequence (AUadapt) from InfluenzaA__AGU01890__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcaggccggggcgaagggcuucuacaagaaccugaucuggcuggugaagaaggggaacagcuaccccaagcucuccaagucguacaucaacgacaagggcaaggaggugcugguccuguggggcauccaccaccccuccaccacggccgaccagcagucgcucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgccaucuacuccaccgucgcgucgucccuggugcugguggucagccucggcgccaucuccuucuggaugugcucgaacgggagccugcagugccggaucugcaucuga

SEQ ID NO: 10682 - RNA, 1701 nt, Artificial Sequence
  derived and/or modified CDS sequence (AUadapt) from InfluenzaA__AGU92645__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacaccuacguguucgugggcaccagccgguacuccaagaaguucaagcccgagaucgagacgcgcccgaagguccgggaccaggaggggcgcaugaacuacuacuggacccugguggagcccggcgacaagaucaccuucgaggccaccgggaaccucguggucccccgguacgccuucgcgauggagcgcgacgccggcucgggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgccaccgggcugcgcaacgucccgucgauccagucccggggccuguucggggccaucgcgggcuucaucgagggcggguggacgggcaugguggacgggugguacggcuaccaccaccagaacgagcaggggagcggcuacgccgccgaccucaaguccacccagaacgccaucgacaagaucaccaacaaggugaacucggucaucgagaagaugaacacccaguucacggccgugggcaaggaguucaaccaccuggagaagcgcaucgagaaccugaacaagaaggucgacgacggguuccucgacaucuggaccuacaacgcggagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggccaucuacuccaccgccgcgagcucccugguccucguggugucgcugggcgccaucuccuucuggaugugcucgaacggcagccugcagugccggaucugcaucuga

SEQ ID NO: 10683 - RNA, 1701 nt, Artificial Sequence
  derived and/or modified CDS sequence (AUadapt) from InfluenzaA__AGU92667__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccucguggucccccgguacgcguucgccauggagcgcgacgccggcucgggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgccaccgggcugcgcaacgucccgucgauccagucccggggccuguucggggcgaucgccggcuucaucgagggcggguggacgggcaugguggacgggugguacggcuaccaccaccagaacgagcaggggagcggcuacgccgccgaccucaaguccacccagaacgccaucgacaagaucaccaacaaggugaacucggucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcgggcccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggcgaucuacuccaccgccgccagcucccugguccucguggugucgcugggcgccaucuccuucuggaugugcucgaacggcagccugcagugccggaucugcaucuga

SEQ ID NO: 10684 - RNA, 1701 nt, Artificial Sequence
  derived and/or modified CDS sequence (AUadapt) from InfluenzaA__AGU92678__HA
augaaggccauccuggugguccuccuguacaccuucgccaccgcgaacgccgacacgcugugcaucggccaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgucguccagcgacaacgggaccugcuaccccggcgacuucaucgacuacgaggagcuccgggagcagcuguccucgguguccucguucgagcgcuucgagaucuuccccaagaccuccucguggcccaaccacgacuccaacaagggcgucaccgccgccugcccgcacgccggcgcgaagggguucuacaagaaccugaucuggcucgugaagaagggcaacucguaccccaagcuguccaagagcuacaucaacgacaaggggaaggaggugcugguccucuggggcauccaccaccccuccacgaccgccgaccagcagucgcuguaccagaacgccgacaccuacguguucgugggcaccucgcgguacuccaagaaguucaagcccgagaucgccacgcgcccgaagguccgggaccaggaggggcgcaugaacuacuacuggacccugguggagcccggcgacaagaucaccuucgaggccaccgggaaccucguggucccccgguacgcguucgccauggagcgcgacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgccaccgggcugcgcaacgucccgucgauccagucccggggccuguucggggcgaucgccggcuucaucgagggcggguggacgggcaugguggacgggugguacggcuaccaccaccagaacgagcaggggucgggcuacgccgccgaccucaaguccacccagaacgccaucgacaagaucaccaacaaggugaacucggucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggccaucuacuccaccgcggccucgucccugguccucguggugucgcugggcgccaucuccuucuggaugugcucgaacggcagccugcagugccggaucugcaucuga

SEQ ID NO: 10685 - RNA, 1701 nt, Artificial Sequence
  derived and/or modified CDS sequence (AUadapt) from InfluenzaA__AGU92711__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagcaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 10686 - RNA, 1701 nt, Artificial Sequence
  derived and/or modified CDS sequence (AUadapt) from InfluenzaA__AGU92722__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucggacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 10687 - RNA, 1701 nt, Artificial Sequence; identical to SEQ ID NO: 10686
  derived and/or modified CDS sequence (AUadapt) from InfluenzaA__AGU92733__HA

SEQ ID NO: 10688 - RNA, 1701 nt, Artificial Sequence
  derived and/or modified CDS sequence (AUadapt) from InfluenzaA__AGU92744__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucggacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacggggccuacgacuaccccaaguacucggaggaggcgaagcugaaccgggaggagaucgacggcgugaagcucgaguccacccgcaucuaccagauccuggccaucuacagcaccgucgccucgucccuggugcucguggucagccugggggccaucuccuucuggaugugcagcaacggcucccugcagugccggaucugcaucuga

SEQ ID NO: 10689 - RNA, 1701 nt, Artificial Sequence
  derived and/or modified CDS sequence (AUadapt) from InfluenzaA__AGU92755__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaaggaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 10690 - RNA, 1701 nt, Artificial Sequence
  derived and/or modified CDS sequence (AUadapt) from InfluenzaA__AGU92766__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgaguccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacgccuacguguucgugggcaccagccgguacuccaagaaguucaagcccgagaucgccacccgcccgaagguccgggaccaggaggggcgcaugaacuacuacuggacgcugguggagcccggcgacaagaucaccuucgaggcgaccgggaaccucguggucccccgguacgccuucgccauggagcgcgacgccggcucgggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacaagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggcgaucuacuccaccgccgccagcucccugguccucguggugucgcugggcgccaucuccuucuggaugugcucgaacggcagccugcagugccggaucugcaucuga

SEQ ID NO: 10691 - RNA, 1701 nt, Artificial Sequence
  derived and/or modified CDS sequence (AUadapt) from InfluenzaA__AGU92777__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgaguccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgaucuaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccugguggucccccgguacgcguucgccauggagcgcgacgccggcucgggcaucaucaucuccgacacgcccgugcacgacugcaacacgaccugccagaccccgaagggggccaucaacaccucgcuccccuuccagaacauccaccccaucaccaucggcaagugccccaaguacgugaaguccaccaagcugcggcuggccaccgggcuccgcaacgucccgucgauccagucccggggccuguucggggcgaucgccggcuucaucgagggcggguggacgggcaugguggacgggugguacggcuaccaccaccagaacgagcaggggagcggcuacgccgccgaccugaaguccacccagaacgccaucgacaagaucaccaacaaggugaacucggucaucgagaagaugaacacccaguucacggcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcuggagucgacccgcaucuaccagauccucgccaucuacuccaccgcggccagcucccugguccugguggugucgcucggcgccaucuccuucuggaugugcucgaacggcagccugcagugccggaucugcaucuga

SEQ ID NO: 10692 - RNA, 1701 nt, Artificial Sequence
  derived and/or modified CDS sequence (AUadapt) from InfluenzaA__AGU92788__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgacuccgacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacgccuacguguucgugggcaccagccgguacuccaagaaguucaagcccgagaucgccacccgcccgaagguccgggaccgcgaggggcggaugaacuacuacuggacgcugguggagcccggcgacaagaucaccuucgaggcgaccgggaaccucguggucccccgcuacgccuucgccauggagcgggacgccggcucgggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugcucgacgggugguacggcuaccaccaccagaacgagcaggggagcggcuacgccgccgaccugaaguccacgcagaacgcgaucgacaagaucaccaacaaggugaacucggugaucgagaagaugaacacccaguucaccgccgucggcaaggaguucaaccaccuggagaagcggaucgagaaccucaacaagaagguggacgacggguuccuggacaucuggacguacaacgccgagcugcucguccugcuggagaacgagcgcacccucgacuaccacgacuccaacgugaagaaccuguacgagaaggugcggaaccagcugaagaacaacgccaaggagaucggcaacgggugcuucgaguucuaccacaagugcgacaacacgugcauggagucggucaagaacggcaccuacgacuaccccaaguacuccgaggaggccaagcucaaccgcgaggagaucgacggggugaagcuggagucgacccggaucuaccagauccuggcgaucuacuccaccgccgccagcucccucgugcuggucgugucgcugggcgccaucuccuucuggaugugcucgaacggcagccuccagugccgcaucugcaucuga

SEQ ID NO: 10693 - RNA, 1701 nt, Artificial Sequence
  derived and/or modified CDS sequence (AUadapt) from InfluenzaA__AGU92799__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccgaccacgacuccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacgccuacguguucgugggcaccagccgguacuccaagaaguucaagcccgagaucgccacccgcccgaagguccgggaccgcgaggggcggaugaacuacuacuggacgcugguggagcccggcgacaagaucaccuucgaggcgaccgggaaccucguggucccccgcuacgccuucgccauggagcgggacgccggcucgggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacaagaucaccaacaaggugaacucggucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagucgacccggaucuaccagauccuggcgaucuacuccaccgccgccagcucccugguccucguggugucgcugggcgccaucuccuucuggaugugcucgaacggcagccugcagugccgcaucugcaucuga

SEQ ID NO: 10694 - RNA, 1701 nt, Artificial Sequence
  derived and/or modified CDS sequence (AUadapt) from InfluenzaA__AGU92821__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggcgcgaagggguucuacaagaaccugaucuggcucgugaagaagggcaacucguaccccaagcuguccaagagcuacaucaacgacaaggggaaggaggugcugguccucuggggcauccaccaccccuccacgaccgccgaccagcagucgcuguaccagaacgccgacaccuacguguucgugggcaccucgcgguacuccaagauguucaagcccgagaucgccacgcgcccgaagguccgggaccgcgaggggcggaugaacuacuacuggacccugguggagcccggcgacaagaucaccuucgaggccaccgggaaccucguggucccccgcuacgcguucgccauggagcgggacgccggcucgggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcgccucgccaccgggcugcggaacgucccgucgauccagucccgcggccuguucggggcgaucgccggcuucaucgagggcggguggacgggcaugguggacgggugguacggcuaccaccaccagaacgagcaggggucgggcuacgccgccgaccucaaguccacccagaacgccaucgacaagaucaccaacaaggugaacagcgucaucgagaagaugaacacccaguucacggcggugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagucgacccggaucuaccagauccuggccaucuacuccaccgcggccagcucccugguccucguggugucgcugggcgccaucuccuucuggaugugcucgaacggcagccugcagugccgcaucugcaucuga

SEQ ID NO: 10695 - RNA, 1701 nt, Artificial Sequence
  derived and/or modified CDS sequence (AUadapt) from InfluenzaA__AGU92843__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaagggggacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 10696 - RNA, 1710 nt, Artificial Sequence
  derived and/or modified CDS sequence (AUadapt) from InfluenzaA__AGU92854__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugagcuccuucgagcgcuucgagaucuuccccaagaccucguccuggcccaaccacgacagcgacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggucgggcaucaucaucuccgacacccccgugcacgacugcaacacgaccugccagaccccgaagggcgccaucaacaccagccugacgucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagucgacccggaucuaccagauccuggcgaucuacagcaccgucgccuccucgcucgugcugguggucucccugggggccaucagcuucuggaugugcuccaacggcagccuccagugccgcaucugcaucuga

SEQ ID NO: 10697 - RNA, 1701 nt, Artificial Sequence
  derived and/or modified CDS sequence (AUadapt) from InfluenzaA__AGU92887__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgacgaccagcagucgcuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggccaccggcaaccucguggucccccgcuacgcguucgccauggagcggaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacucggucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggccaucuacagcaccgucgcgucgucccuggugcucguggucagccugggggccaucuccuucuggaugugcagcaacggcucccugcagugccgcaucugcaucuga

SEQ ID NO: 10698 - RNA, 1701 nt, Artificial Sequence; identical to SEQ ID NO: 10682
  derived and/or modified CDS sequence (AUadapt) from InfluenzaA__AGU92898__HA

SEQ ID NO: 10699 - RNA, 1701 nt, Artificial Sequence; identical to SEQ ID NO: 10683
  derived and/or modified CDS sequence (AUadapt) from InfluenzaA__AGU92909__HA

SEQ ID NO: 10700 - RNA, 1701 nt, Artificial Sequence; identical to SEQ ID NO: 10685
  derived and/or modified CDS sequence (AUadapt) from InfluenzaA__AGU92931__HA

SEQ ID NO: 10701 - RNA, 1701 nt, Artificial Sequence; identical to SEQ ID NO: 10686
  derived and/or modified CDS sequence (AUadapt) from InfluenzaA__AGU92942__HA

SEQ ID NO: 10702 - RNA, 1701 nt, Artificial Sequence; identical to SEQ ID NO: 10686
  derived and/or modified CDS sequence (AUadapt) from InfluenzaA__AGU92953__HA

SEQ ID NO: 10703 - RNA, 1701 nt, Artificial Sequence
  derived and/or modified CDS sequence (AUadapt) from InfluenzaA__AGU92964__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacgccuacguguucgugggcaccagccgguacuccaagaaguucaagcccgagaucgccacccgcccgaagguccgggaccgcgaggggcggaugaacuacuacuggacgcugguggagcccggcgacaagaucaccuucgaggcgaccgggaaccucguggucccccgcuacgccuucgccauggagcgggacgccggcucgggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugcucgacgggugguacggcuaccaccaccagaacgagcaggggagcggcuacgccgccgaccugaaguccacgcagaacgcgaucgacaagaucaccaacaaggugaacucggugaucgagaagaugaacacccaguucaccgccgucggcaaggaguucaaccaccuggagaagcggaucgagaaccucaacaagaagguggacgacggguuccuggacaucuggacguacaacgccgagcugcucguccugcuggagaacgagcgcacccucgacuaccacgacuccaacgugaagaaccuguacgagaaggugcggaaccagcugaagaacaacgccaaggagaucggcaacgggugcuucgaguucuaccacaagugcgacaacacgugcauggagucggucaagaacggcaccuacgacuaccccaaguacuccgaggaggccaagcucaaccgcgaggagaucgacggggugaagcuggagucgacccggaucuaccagauccuggcgaucuacuccaccgccgccagcucccucgugcuggucgugucgcugggcgccaucuccuucuggaugugcucgaacggcagccuccagugccgcaucugcaucuga

SEQ ID NO: 10704 - RNA, 1701 nt, Artificial Sequence
  derived and/or modified CDS sequence (AUadapt) from InfluenzaA__AGU92975__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggcgcgaagggguucuacaagaaccugaucuggcucgugaagaaggagaacucguaccccaagcuguccaagucguacaucaacgacaagggcaaggaggugcugguccucugggggauccaccaccccuccacgaccgccgaccagcagucgcuguaccagaacgccgacaccuacguguucgugggcaccagccgguacuccaagaaguucaagcccgagaucgccacgcgcccgaagguccgggaccgcgagggccggaugaacuacuacuggacccugguggagcccggggacaagaucaccuucgaggccaccggcaaccucguggucccccgcuacgcguucgccauggagcgggacgccgggucgggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcgccucgccaccggccugcggaacgucccgucgauccagucccgcgggcuguucggcgcgaucgccggguucaucgagggcggcuggacggggaugguggacggcugguacggguaccaccaccagaacgagcagggcagcggguacgccgccgaccucaaguccacccagaacgccaucgacaagaucaccaacaaggugaacucggucaucgagaagaugaacacccaguucacggcggugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagucgacccggaucuaccagauccuggccaucuacuccaccgcggccagcucccugguccucguggugucgcugggggccaucuccuucuggaugugcucgaacggcagccugcagugccgcaucugcaucuga

SEQ ID NO: 10705 - RNA, 1701 nt, Artificial Sequence; identical to SEQ ID NO: 10695
  derived and/or modified CDS sequence (AUadapt) from InfluenzaA__AGU92986__HA

SEQ ID NO: 10706 - RNA, 1701 nt, Artificial Sequence
  derived and/or modified CDS sequence (AUadapt) from InfluenzaA__AGU92997__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcuccucgcgguacuccaagauguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccucgcugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 10707 - RNA, 1701 nt, Artificial Sequence; identical to SEQ ID NO: 10697
  derived and/or modified CDS sequence (AUadapt) from InfluenzaA__AGU93008__HA

SEQ ID NO: 10708 - RNA, 1698 nt, Artificial Sequence; identical to SEQ ID NO: 6799
  derived and/or modified CDS sequence (AUadapt) from InfluenzaA__AGU93019__HA

SEQ ID NO: 10709 - RNA, 1701 nt, Artificial Sequence; identical to SEQ ID NO: 7295
  derived and/or modified CDS sequence (AUadapt) from InfluenzaA__AGU93031__HA

SEQ ID NO: 10710 - RNA, 1701 nt, Artificial Sequence
  derived and/or modified CDS sequence (AUadapt) from InfluenzaA__AGU93042__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccaacuccuggucguacaucguggagacguccagcuccgacaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcacgaccgccgaccagcagucccuguaccagaacgccgacaccuacguguucgugggcaccucgcgguacucgaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcuccggcaucaucaucagcgacacccccgugcacgacugcaacacgaccugccagaccccgaagggggccaucaacaccucccugcccuuccagaacauccaccccaucacgaucggcaagugccccaaguacgucaagucgaccaagcugcggcucgccaccgggcugcgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacauccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacagcaccgcggccuccucgcugguccucguggugucccugggcgccaucucguucuggaugugcuccaacggcagccugcagugccggaucugcaucuga

SEQ ID NO: 10711 - RNA, 1701 nt, Artificial Sequence
  derived and/or modified CDS sequence (AUadapt) from InfluenzaA__AGU93053__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccucguucgagcgcuucgagaucuuccccaagaccuccagcuggcccaaccacgacuccaacaagggcgucaccgccgccugcccgcacgccggcgcgaagggguucuacaagaaccugaucuggcucgugaagaagggcaacucguaccccaagcuguccaagucguacaucaacgacaaggggaaggaggugcugguccucuggggcauccaccaccccuccacgaccgccgaccagcagucgcuguaccagaacgccgacaccuacguguucgugggcaccagccgguacuccaagaaguucaagcccgagaucgccacgcgcccgaagguccgggaccaggaggggcgcaugaacuacuacuggacccugguggagcccggcgacaagaucaccuucgaggccaccgggaaccucguggucccccgguacgcguucgccauggagcgcgacgccggcucgggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgccaccgggcugcgcaacgucccgucgauccagucccggggccuguucggggcgaucgccggcuucaucgagggcggguggacgggcaugguggacgggugguacggcuaccaccaccagaacgagcaggggagcggcuacgccgccgaccucaaguccacccagaacgccaucgacaagaucaccaacaaggugaacucggucaucgagaagaugaacacccaguucacggcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggccaucuacuccaccgcggccagcucccugguccucguggugucgcugggcgccaucuccuucuggaugugcucgaacggcagccugcagugccggaucugcaucuga

SEQ ID NO: 10712 - RNA, 1701 nt, Artificial Sequence
  derived and/or modified CDS sequence (AUadapt) from InfluenzaA__AGV99014__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaaggggguggagcucaagucgggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 10713 - RNA, 1701 nt, Artificial Sequence; identical to SEQ ID NO: 162
  derived and/or modified CDS sequence (AUadapt) from InfluenzaA__AGV99037__HA

SEQ ID NO: 10714 - RNA, 1701 nt, Artificial Sequence
  derived and/or modified CDS sequence (AUadapt) from InfluenzaA__AGV99049__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccucggggcgcaucaccguguccaccaagcggagccagcaggccgucaucccgaacaucggcucgcgcccccggauccgcaacauccccucccggaucagcaucuacuggacgaucgugaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgucaagcagucgacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacggcaaguuccaccagaucgagaaggaguucuccgaggucgaggggcgcauccaggaccuggagaaguacguggaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcgugguccugcucggguucaucaugugggccugccagaagggcaacauccgcugcaacaucugcaucuga

SEQ ID NO: 10715 - RNA, 1701 nt, Artificial Sequence
  derived and/or modified CDS sequence (AUadapt) from InfluenzaA__AGV99073__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcaacuccucguucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugucgaccaagcgcagccagcaggccgugaucccgaacaucggcucccggccccgcauccggaacauccccucgcgcaucuccaucuacuggacgaucgucaagcccggggacauccugcugaucaacagcaccggcaaccucaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagacgaacgagaaguuccaccagaucgagaaggaguucucggagguggaggggcggauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagcccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 10716 - RNA, 1701 nt, Artificial Sequence; identical to SEQ ID NO: 10103
  derived and/or modified CDS sequence (AUadapt) from InfluenzaA__AGV99085__HA

SEQ ID NO: 10717 - RNA, 1701 nt, Artificial Sequence
  derived and/or modified CDS sequence (AUadapt) from InfluenzaA__AGV99097__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagauccucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10718 - RNA, 1701 nt, Artificial Sequence
  derived and/or modified CDS sequence (AUadapt) from InfluenzaA__AGV99121__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacgacuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggcgugacgcagaacgggaccucguccgccugcauccggggcagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcggaucaccgugagcaccaagcgcucgcagcaggccgugaucccgaacaucggcucccggccccgcauccggaacauccccagccgcaucuccaucuacuggaccaucgucaagcccggcgacauccugcucaucaacucgacggggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggcgugcccccgguacgugaagcaguccacccugaagcucgccacgggcaugcgcaacguccccgagaagcagacccgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 10719 - RNA, 1701 nt, Artificial Sequence; identical to SEQ ID NO: 10718
  derived and/or modified CDS sequence (AUadapt) from InfluenzaA__AGV99133__HA

SEQ ID NO: 10720 - RNA, 1701 nt, Artificial Sequence; identical to SEQ ID NO: 10712
  derived and/or modified CDS sequence (AUadapt) from InfluenzaA__AGV99145__HA

SEQ ID NO: 10721 - RNA, 1701 nt, Artificial Sequence
  derived and/or modified CDS sequence (AUadapt) from InfluenzaA__AGV99157__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcucgcucguggccuccagcggcacccuggaguucaacaacgaguccuucaacuggacgggggucacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucucgaccaagcggagccagcaggccgugaucccgaacaucggcucccgcccccggauccgcaacauccccucgcggaucuccaucuacuggacgaucgugaagcccggcgacauccugcugaucaacagcaccgggaaccucaucgccccgcgcggcuacuucaagauccgguccggcaagucguccaucaugcgcagcgacacccccaucgggaagugcaaguccgagugcaucacccccaacggcucgauccccaacgacaagccguuccagaacgucaaccggaucacguacggggccugcccccgcuacgugaagcaguccacccugaagcuggccaccggcaugcggaacgugcccgagaagcagacccgcgggaucuucggcgcgaucgccggguucaucgagaacggcugggagggcaugauggacgggugguacggcuuccggcaccagaacagcgaggggcgcggccaggccgccgaccucaaguccacgcaggccgcgaucgaccagaucaacgggaagcugaaccggcugaucggcaagaccaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccggaacggcaccuacgaccacgacgucuaccgcgacgaggcgcugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10722 - RNA, 1701 nt, Artificial Sequence; identical to SEQ ID NO: 162
  derived and/or modified CDS sequence (AUadapt) from InfluenzaA__AGV99169__HA

SEQ ID NO: 10723 - RNA, 1701 nt, Artificial Sequence; identical to SEQ ID NO: 10712
  derived and/or modified CDS sequence (AUadapt) from InfluenzaA__AGV99181__HA

SEQ ID NO: 10724 - RNA, 1701 nt, Artificial Sequence
  derived and/or modified CDS sequence (AUadapt) from InfluenzaA__AGV99193__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacacccccaucgggaagugcaaguccgagugcaucacccccaacggcucgauccccaacgacaagccguuccagaacgugaaccggaucacguacggggccugcccccgcuacgugaagcaguccacccugaagcuggccaccggcaugcggaacguccccgagaagcagacccgcgggaucuucggcgcgaucgccggguucaucgagaacggcugggagggcaugauggacgggugguacggcuuccggcaccagaacagcgaggggcgcggccaggccgccgaccucaaguccacgcaggccgcgaucgaccagaucaacgggaagcugaaccggcugaucggcaagaccaacgagaaguuccaccagaucgagaaggaguucucggagguggagggccgcauccaggaccucgagaaguacguggaggacaccaagaucgaccugugguccuacaacgccgagcugcucgucgcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaaggggguggagcucaagucgggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 10725 - RNA, 1701 nt, Artificial Sequence; identical to SEQ ID NO: 10113
  derived and/or modified CDS sequence (AUadapt) from InfluenzaA__AGV99956__HA

SEQ ID NO: 10726 - RNA, 1701 nt, Artificial Sequence
  derived and/or modified CDS sequence (AUadapt) from InfluenzaA__AGV99986__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucaucgccuccagcggcacccuggaguucaacaacgaguccuucaacuggacgggggucacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucucgaccaagcggagccagcaggccgugaucccgaacaucggcucccgcccccggauccgcaacauccccucgcggaucuccaucuacuggacgaucgugaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10727 - RNA, 1701 nt, Artificial Sequence
  derived and/or modified CDS sequence (AUadapt) from InfluenzaA__AGW00065__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacaccucccugcgcucgcucgucgcguccagcggcacgcuggaguucaacaacgaguccuucaacuggaccggggugacccagaacggcaccucguccgccugcauccggcgcagcaacuccucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggucgcagcaggcggugaucccgaacaucggcucccgcccccggauccgcaacauccccagccggaucuccaucuacuggaccaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacucggaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10728 - RNA, 1701 nt, Artificial Sequence; identical to SEQ ID NO: 162
  derived and/or modified CDS sequence (AUadapt) from InfluenzaA__AGW00077__HA

SEQ ID NO: 10729 - RNA, 1701 nt, Artificial Sequence; identical to SEQ ID NO: 10103
  derived and/or modified CDS sequence (AUadapt) from InfluenzaA__AGW00089__HA

SEQ ID NO: 10730 - RNA, 1701 nt, Artificial Sequence; identical to SEQ ID NO: 162
  derived and/or modified CDS sequence (AUadapt) from InfluenzaA__AGW00101__HA

SEQ ID NO: 10731 - RNA, 1701 nt, Artificial Sequence
  derived and/or modified CDS sequence (AUadapt) from InfluenzaA__AGW00113__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaccuuccuguacgcccagagcuccggccggaucaccgugucgaccaagcgcagccagcaggccgugaucccgaacaucggcucccggccccgcauccggaacauccccucgcgcaucuccaucuacuggacgaucgucaagcccggggacauccugcucaucaacagcaccggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucucggagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10732 - RNA, 1701 nt, Artificial Sequence; identical to SEQ ID NO: 162
  derived and/or modified CDS sequence (AUadapt) from InfluenzaA__AGW00125__HA

SEQ ID NO: 10733 - RNA, 1701 nt, Artificial Sequence; identical to SEQ ID NO: 162
  derived and/or modified CDS sequence (AUadapt) from InfluenzaA__AGW00137__HA

SEQ ID NO: 10734 - RNA, 1701 nt, Artificial Sequence; identical to SEQ ID NO: 162
  derived and/or modified CDS sequence (AUadapt) from InfluenzaA__AGW00149__HA

SEQ ID NO: 10735 - RNA, 1701 nt, Artificial Sequence; identical to SEQ ID NO: 162
  derived and/or modified CDS sequence (AUadapt) from InfluenzaA__AGW00161__HA

SEQ ID NO: 10736 - RNA, 1701 nt, Artificial Sequence; identical to SEQ ID NO: 162
  derived and/or modified CDS sequence (AUadapt) from InfluenzaA__AGW00173__HA

SEQ ID NO: 10737 - RNA, 1701 nt, Artificial Sequence
  derived and/or modified CDS sequence (AUadapt) from InfluenzaA__AGW00185__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcucgcucguggccuccagcggcacccuggaguucaacaacgaguccuucaacuggacgggggucacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcgugcaccaccccgggaccgacaaggaccagaucuuccucuacgcgcagagcuccgggcgcaucaccgucucgaccaagcggagccagcaggccgugaucccgaacaucggcucccgcccccggauccgcaacauccccucgcggaucuccaucuacuggacgaucgugaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10738 - RNA, 1701 nt, Artificial Sequence; identical to SEQ ID NO: 162
  derived and/or modified CDS sequence (AUadapt) from InfluenzaA__AGW00709__HA

SEQ ID NO: 10739 - RNA, 1701 nt, Artificial Sequence; identical to SEQ ID NO: 162
  derived and/or modified CDS sequence (AUadapt) from InfluenzaA__AGW00721__HA

SEQ ID NO: 10740 - RNA, 1701 nt, Artificial Sequence; identical to SEQ ID NO: 162
  derived and/or modified CDS sequence (AUadapt) from InfluenzaA__AGW00733__HA

SEQ ID NO: 10741 - RNA, 1701 nt, Artificial Sequence; identical to SEQ ID NO: 162
  derived and/or modified CDS sequence (AUadapt) from InfluenzaA__AGW00745__HA

SEQ ID NO: 10742 - RNA, 1701 nt, Artificial Sequence
  derived and/or modified CDS sequence (AUadapt) from InfluenzaA__AGW00757__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaaccugaaccgcaucaccuacggcgcgugcccccgguacgugaagcaguccacccucaagcuggccacggggaugcgcaacgugcccgagaagcagacccggggcaucuucggggccaucgccggcuucaucgagaacggcugggaggggauggucgacggcugguacggguuccgccaccagaacucggagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacguggaggacacgaagaucgaccucugguccuacaacgccgagcugcuggucgcccucgagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcugugcgucgcccuccugggguucaucaugugggcgugccagaagggcaacauccggugcaacaucugcaucuga

SEQ ID NO: 10743 - RNA, 1701 nt, Artificial Sequence; identical to SEQ ID NO: 10242
  derived and/or modified CDS sequence (AUadapt) from InfluenzaA__AGW00769__HA

SEQ ID NO: 10744 - RNA, 1701 nt, Artificial Sequence; identical to SEQ ID NO: 10128
  derived and/or modified CDS sequence (AUadapt) from InfluenzaA__AGW00781__HA

SEQ ID NO: 10745 - RNA, 1701 nt, Artificial Sequence; identical to SEQ ID NO: 10727
  derived and/or modified CDS sequence (AUadapt) from InfluenzaA__AGW00793__HA

SEQ ID NO: 10746 - RNA, 1701 nt, Artificial Sequence; identical to SEQ ID NO: 162
  derived and/or modified CDS sequence (AUadapt) from InfluenzaA__AGW00805__HA

SEQ ID NO: 10747 - RNA, 1701 nt, Artificial Sequence; identical to SEQ ID NO: 10080
  derived and/or modified CDS sequence (AUadapt) from InfluenzaA__AGW00817__HA

SEQ ID NO: 10748 - RNA, 1701 nt, Artificial Sequence; identical to SEQ ID NO: 10726
  derived and/or modified CDS sequence (AUadapt) from InfluenzaA__AGW00829__HA

SEQ ID NO: 10749 - RNA, 1701 nt, Artificial Sequence
  derived and/or modified CDS sequence (AUadapt) from InfluenzaA__AGW00841__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgggcgcaucgaggugacgaacgccaccgagcugguccagaacagcuccaucggcgagaucugcgacucgccccaccagauccucgacggggagaacugcacccugaucgacgcccugcucggcgacccccagugcgacggcuuccagaacaagaagugggaccuguucguggagcgguccaaggccuacagcaacugcuaccccuacgacgugccggacuacgcgucccugcgcucgcucgucgccuccagcgggacccuggaguucaacaacgaguccuucaacugggccggcgugacgcagaacgggaccucguccgccugcauccggggcagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucgggucccggccccgcauccggaacauccccagccgcaucuccaucuacuggaccaucgucaagcccggcgacauccugcucaucaacucgacggggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggcgugcccccgguacgugaagcaguccacccugaagcucgccacgggcaugcgcaacguccccgagaagcagacccgggggaucuucggcgccaucgccggcuucaucgagaacgggugggagggcaugguggacgggugguacggcuuccgccaccagaacucggaggggcggggccaggccgcggaccugaaguccacccaggccgccaucgaccagaucaacggcaagcugaaccgccucaucgggaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggcgucgagcucaagagcggguacaaggacuggauccuguggaucuccuucgccaucagcugcuuccugcugugcguggcccugcucggcuucaucaugugggcgugccagaaggggaacauccggugcaacaucugcaucuga

SEQ ID NO: 10750 - RNA, 1701 nt, Artificial Sequence
  derived and/or modified CDS sequence (AUadapt) from InfluenzaA__AGW00853__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagccgagcgggcgcaucaccguguccaccaagcggucgcagcaggccgugauccccaacaucggcagccgcccccggauccgcaacauccccucccggaucucgaucuacuggacgaucgucaagccgggcgacauccugcucaucaacuccaccgggaaccugaucgcgccccgcggcuacuucaagauccggagcgggaaguccucgaucaugcgcuccgacgcccccaucggcaagugcaagagcgagugcaucacccccaacggcuccaucccgaacgacaagcccuuccagaacgugaaccggaucaccuacggggccugcccccgcuacgugaagcagucgacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 10751 - RNA, 1701 nt, Artificial Sequence; identical to SEQ ID NO: 10103
  derived and/or modified CDS sequence (AUadapt) from InfluenzaA__AGW00865__HA

SEQ ID NO: 10752 - RNA, 1701 nt, Artificial Sequence
  derived and/or modified CDS sequence (AUadapt) from InfluenzaA__AGW00877__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcuuccggccccgcguccggaacauccccucgcgcguguccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 10753 - RNA, 1701 nt, Artificial Sequence
  derived and/or modified CDS sequence (AUadapt) from InfluenzaA__AGW00889__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacugggugcuguggaucuccuucgccaucagcugcuuccugcugugcguggcccugcucggcuucaucaugugggccugccagaaggggaacauccgcugcaacaucugcaucuga

SEQ ID NO: 10754 - RNA, 1701 nt, Artificial Sequence; identical to SEQ ID NO: 10103
  derived and/or modified CDS sequence (AUadapt) from InfluenzaA__AGW00901__HA

SEQ ID NO: 10755 - RNA, 1701 nt, Artificial Sequence; identical to SEQ ID NO: 10103
  derived and/or modified CDS sequence (AUadapt) from InfluenzaA__AGW00913__HA

SEQ ID NO: 10756 - RNA, 1701 nt, Artificial Sequence; identical to SEQ ID NO: 162
  derived and/or modified CDS sequence (AUadapt) from InfluenzaA__AGW00931__HA

SEQ ID NO: 10757 - RNA, 1701 nt, Artificial Sequence; identical to SEQ ID NO: 162
  derived and/or modified CDS sequence (AUadapt) from InfluenzaA__AGW01244__HA

SEQ ID NO: 10758 - RNA, 1701 nt, Artificial Sequence; identical to SEQ ID NO: 10113
  derived and/or modified CDS sequence (AUadapt) from InfluenzaA__AGW01256__HA

SEQ ID NO: 10759 - RNA, 1701 nt, Artificial Sequence
  derived and/or modified CDS sequence (AUadapt) from InfluenzaA__AGW01295__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagauccucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 10760 - RNA, 1701 nt, Artificial Sequence; identical to SEQ ID NO: 10103
  derived and/or modified CDS sequence (AUadapt) from InfluenzaA__AGW01307__HA

SEQ ID NO: 10761 - RNA, 1701 nt, Artificial Sequence
  derived and/or modified CDS sequence (AUadapt) from InfluenzaA__AGW01319__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccaggacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaacaagcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 10762 - RNA, 1701 nt, Artificial Sequence
  derived and/or modified CDS sequence (AUadapt) from InfluenzaA__AGW01331__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgagcacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10763 - RNA, 1701 nt, Artificial Sequence; identical to SEQ ID NO: 162
  derived and/or modified CDS sequence (AUadapt) from InfluenzaA__AGW01343__HA

SEQ ID NO: 10764 - RNA, 1701 nt, Artificial Sequence; identical to SEQ ID NO: 10242
  derived and/or modified CDS sequence (AUadapt) from InfluenzaA__AGW01355__HA

SEQ ID NO: 10765 - RNA, 1701 nt, Artificial Sequence; identical to SEQ ID NO: 10113
  derived and/or modified CDS sequence (AUadapt) from InfluenzaA__AGW01367__HA

SEQ ID NO: 10766 - RNA, 1701 nt, Artificial Sequence; identical to SEQ ID NO: 162
  derived and/or modified CDS sequence (AUadapt) from InfluenzaA__AGW01391__HA

SEQ ID NO: 10767 - RNA, 1701 nt, Artificial Sequence
  derived and/or modified CDS sequence (AUadapt) from InfluenzaA__AGW01403__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccggggagaucugcaacucgccccaccagauccucgacggcgagaacugcacccugaucgacgcccugcucggggacccccagugcgacggcuuccagaacaagaagugggaccuguucgucgagcgcucgaaggcccacuccaacugcuaccccuacgacgugccggacuacgcgagccugcggucccucguggccucguccggcacgcuggaguucaacaacgagucguucaacuggaccggggucacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccgccgggcggaucaccgucucgacgaagcgcucccagcaggccgugaucccgaacaucggcagccggccccgcgugcggaacauccccucgcgcgucuccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacuacgucuaccgggacgaggcccucaacaaccgcuuccagaucaaggggguggagcugaaguccggcuacaaggacuggauccuguggaucagcuucgcgaccuccugcuuccuccugugcguggcccugcucggcuucaucaugugggccugccagaaggggaacauccggugcaacaucugcaucuga

SEQ ID NO: 10768 - RNA, 1701 nt, Artificial Sequence; identical to SEQ ID NO: 10103
  derived and/or modified CDS sequence (AUadapt) from InfluenzaA__AGW01415__HA

SEQ ID NO: 10769 - RNA, 1701 nt, Artificial Sequence; identical to SEQ ID NO: 10103
  derived and/or modified CDS sequence (AUadapt) from InfluenzaA__AGW01427__HA

SEQ ID NO: 10770 - RNA, 1701 nt, Artificial Sequence; identical to SEQ ID NO: 10103
  derived and/or modified CDS sequence (AUadapt) from InfluenzaA__AGW01439__HA

SEQ ID NO: 10771 - RNA, 1701 nt, Artificial Sequence
  derived and/or modified CDS sequence (AUadapt) from InfluenzaA__AGW01451__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggucgacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10772 - RNA, 1701 nt, Artificial Sequence; identical to SEQ ID NO: 162
  derived and/or modified CDS sequence (AUadapt) from InfluenzaA__AGW01463__HA

SEQ ID NO: 10773 - RNA, 1701 nt, Artificial Sequence; identical to SEQ ID NO: 162
  derived and/or modified CDS sequence (AUadapt) from InfluenzaA__AGW01475__HA

SEQ ID NO: 10774 - RNA, 1701 nt, Artificial Sequence
  derived and/or modified CDS sequence (AUadapt) from InfluenzaA__AGW01487__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcguccaccaccccgggaccgggaaggaccagaucuuccucuacgcgcagagcuccggccgcaucaccgugucgaccaagcggagccagcaggccgugaucccgaacaucggcucccgcccccggauccgcaacauccccucgcggaucuccaucuacuggacgaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucaccuacggcgccugcccccgcuacgugaagcaguccacgcugaagcuggcgaccgggaugcggaacguccccgagaagcagacccgcggcaucuucggggccaucgccggcuucaucgagaacggcugggaggggaugauggacggcugguacggguuccggcaccagaacagcgagggccgcgggcaggccgccgaccucaaguccacccaggcggccaucgaccagaucaacggcaagcugaaccggcugaucggcaagacgaacgagaaguuccaccagaucgagaaggaguucucggagguggaggggcgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcguggagcucaagucgggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 10775 - RNA, 1701 nt, Artificial Sequence; identical to SEQ ID NO: 10103
  derived and/or modified CDS sequence (AUadapt) from InfluenzaA__AGW01499__HA

SEQ ID NO: 10776 - RNA, 1701 nt, Artificial Sequence
  derived and/or modified CDS sequence (AUadapt) from InfluenzaA__AGW01511__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagucgggcuacaaggacuggauccuguggaucuccuucgccaucagcugcuuccugcugugcgccgcgcugcucggguucaucaugugggccugccagaagggcaacauccggugcaacaucugcaucuga

SEQ ID NO: 10777 - RNA, 1701 nt, Artificial Sequence
  derived and/or modified CDS sequence (AUadapt) from InfluenzaA__AGW01535__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaaggaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 10778 - RNA, 1701 nt, Artificial Sequence; identical to SEQ ID NO: 10103
  derived and/or modified CDS sequence (AUadapt) from InfluenzaA__AGW01547__HA

SEQ ID NO: 10779 - RNA, 1701 nt, Artificial Sequence; identical to SEQ ID NO: 162
  derived and/or modified CDS sequence (AUadapt) from InfluenzaA__AGW01559__HA

SEQ ID NO: 10780 - RNA, 1701 nt, Artificial Sequence; identical to SEQ ID NO: 162
  derived and/or modified CDS sequence (AUadapt) from InfluenzaA__AGW01571__HA

SEQ ID NO: 10781 - RNA, 1701 nt, Artificial Sequence; identical to SEQ ID NO: 162
  derived and/or modified CDS sequence (AUadapt) from InfluenzaA__AGW01583__HA

SEQ ID NO: 10782 - RNA, 1701 nt, Artificial Sequence; identical to SEQ ID NO: 162
  derived and/or modified CDS sequence (AUadapt) from InfluenzaA__AGW01595__HA

SEQ ID NO: 10783 - RNA, 1701 nt, Artificial Sequence
  derived and/or modified CDS sequence (AUadapt) from InfluenzaA__AGW01607__HA
augaagaccaucaucgcccugucguacauccucugccuggugcuggcccagaagcuccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacucgccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcucgcuggucgccuccagcggcacccuggaguucaacaacgaguccuucaacugggccggggugacgcagaacggcaccucguccgccugcauccgggggagcaacuccucguucuucucccgccucaacuggcugacccaccugaacuucaaguaccccgcgcucaacgugaccaugcccaacaacgagcaguucgacaagcuguacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccuccugaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccucaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcucaaccgccugaucggcaagaccaacgagaaguuccaccagaucgagaaggaguucucggagguggaggggcggauccaggaccuggagaaguacgucgaggacacgaagaucgaccucugguccuacaacgccgagcugcugguggcccucgagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagucgggcuacaaggacuggauccuguggaucuccuucgccaucagcugcuuccugcugugcguggcccuccugggguucaucaugugggcgugccagaagggcaacauccggugcaacaucugcaucuga

SEQ ID NO: 10784 - RNA, 1701 nt, Artificial Sequence; identical to SEQ ID NO: 10242
  derived and/or modified CDS sequence (AUadapt) from InfluenzaA__AGW01619__HA

SEQ ID NO: 10785 - RNA, 1701 nt, Artificial Sequence; identical to SEQ ID NO: 162
  derived and/or modified CDS sequence (AUadapt) from InfluenzaA__AGW01631__HA

SEQ ID NO: 10786 - RNA, 1701 nt, Artificial Sequence
  derived and/or modified CDS sequence (AUadapt) from InfluenzaA__AGW01643__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccgggggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccggaucaccgugagcaccaagcgcucgcagcaggccgugaucccgaacaucggcucccggccccgcauccggaacauccccagccgcaucuccaucuacuggacgaucgucaagcccggggacauccugcucaucaacucgaccggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugauggacggcugguacggguuccgccaccagaacucggagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 10787 - RNA, 1701 nt, Artificial Sequence; identical to SEQ ID NO: 162
  derived and/or modified CDS sequence (AUadapt) from InfluenzaA__AGW01655__HA

SEQ ID NO: 10788 - RNA, 1701 nt, Artificial Sequence
  derived and/or modified CDS sequence (AUadapt) from InfluenzaA__AGW01667__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgagacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 10789 - RNA, 1701 nt, Artificial Sequence; identical to SEQ ID NO: 162
  derived and/or modified CDS sequence (AUadapt) from InfluenzaA__AGW01679__HA

SEQ ID NO: 10790 - RNA, 1701 nt, Artificial Sequence
  derived and/or modified CDS sequence (AUadapt) from InfluenzaA__AGW01691__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucgugaugugggccugccagaaggggaacauccgcugcaacaucugcaucuga

SEQ ID NO: 10791 - RNA, 1701 nt, Artificial Sequence; identical to SEQ ID NO: 10103
  derived and/or modified CDS sequence (AUadapt) from InfluenzaA__AGW01701__HA

SEQ ID NO: 10792 - RNA, 1701 nt, Artificial Sequence; identical to SEQ ID NO: 10103
  derived and/or modified CDS sequence (AUadapt) from InfluenzaA__AGW01713__HA

SEQ ID NO: 10793 - RNA, 1701 nt, Artificial Sequence
  derived and/or modified CDS sequence (AUadapt) from InfluenzaA__AGW01725__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugaucugcguggcccugcugggcuucaucaugugggccugccagaaggggaacauccgcugcaacaucugcaucuga

SEQ ID NO: 10794 - RNA, 1701 nt, Artificial Sequence; identical to SEQ ID NO: 10103
  derived and/or modified CDS sequence (AUadapt) from InfluenzaA__AGW01737__HA

SEQ ID NO: 10795 - RNA, 1701 nt, Artificial Sequence; identical to SEQ ID NO: 162
  derived and/or modified CDS sequence (AUadapt) from InfluenzaA__AGW01749__HA

SEQ ID NO: 10796 - RNA, 1701 nt, Artificial Sequence; identical to SEQ ID NO: 162
  derived and/or modified CDS sequence (AUadapt) from InfluenzaA__AGW01761__HA

SEQ ID NO: 10797 - RNA, 1701 nt, Artificial Sequence; identical to SEQ ID NO: 10103
  derived and/or modified CDS sequence (AUadapt) from InfluenzaA__AGW01773__HA

SEQ ID NO: 10798 - RNA, 1701 nt, Artificial Sequence; identical to SEQ ID NO: 162
  derived and/or modified CDS sequence (AUadapt) from InfluenzaA__AGW01785__HA

SEQ ID NO: 10799 - RNA, 1701 nt, Artificial Sequence; identical to SEQ ID NO: 10103
  derived and/or modified CDS sequence (AUadapt) from InfluenzaA__AGW01797__HA

SEQ ID NO: 10800 - RNA, 1701 nt, Artificial Sequence; identical to SEQ ID NO: 162
  derived and/or modified CDS sequence (AUadapt) from InfluenzaA__AGW01809__HA

SEQ ID NO: 10801 - RNA, 1701 nt, Artificial Sequence; identical to SEQ ID NO: 162
  derived and/or modified CDS sequence (AUadapt) from InfluenzaA__AGW01821__HA

SEQ ID NO: 10802 - RNA, 1701 nt, Artificial Sequence; identical to SEQ ID NO: 10238
  derived and/or modified CDS sequence (AUadapt) from InfluenzaA__AGW01833__HA

SEQ ID NO: 10803 - RNA, 1701 nt, Artificial Sequence
  derived and/or modified CDS sequence (AUadapt) from InfluenzaA__AGW01845__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucacgaacgaguccuucaacuggaccggggugacccagaacggcaccucguccgccugcauccggcgcagcaacuccucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcgcaucaccgugagcacgaagcggucgcagcaggccgugaucccgaacaucggcucccgcccccggauccgcaacauccccagccggaucuccaucuacuggaccaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcaguccacccugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 10804 - RNA, 1701 nt, Artificial Sequence; identical to SEQ ID NO: 162
  derived and/or modified CDS sequence (AUadapt) from InfluenzaA__AGW01857__HA

SEQ ID NO: 10805 - RNA, 1701 nt, Artificial Sequence; identical to SEQ ID NO: 162
  derived and/or modified CDS sequence (AUadapt) from InfluenzaA__AGW01869__HA

SEQ ID NO: 10806 - RNA, 1701 nt, Artificial Sequence; identical to SEQ ID NO: 10790
  derived and/or modified CDS sequence (AUadapt) from InfluenzaA__AGW01881__HA

SEQ ID NO: 10807 - RNA, 1701 nt, Artificial Sequence; identical to SEQ ID NO: 10113
  derived and/or modified CDS sequence (AUadapt) from InfluenzaA__AGW01893__HA

SEQ ID NO: 10808 - RNA, 1701 nt, Artificial Sequence; identical to SEQ ID NO: 10128
  derived and/or modified CDS sequence (AUadapt) from InfluenzaA__AGW01905__HA

SEQ ID NO: 10809 - RNA, 1701 nt, Artificial Sequence; identical to SEQ ID NO: 162
  derived and/or modified CDS sequence (AUadapt) from InfluenzaA__AGW01917__HA

SEQ ID NO: 10810 - RNA, 1701 nt, Artificial Sequence; identical to SEQ ID NO: 10103
  derived and/or modified CDS sequence (AUadapt) from InfluenzaA__AGW01929__HA

SEQ ID NO: 10811 - RNA, 1701 nt, Artificial Sequence; identical to SEQ ID NO: 162
  derived and/or modified CDS sequence (AUadapt) from InfluenzaA__AGW01941__HA

SEQ ID NO: 10812 - RNA, 1701 nt, Artificial Sequence; identical to SEQ ID NO: 10103
  derived and/or modified CDS sequence (AUadapt) from InfluenzaA__AGW01953__HA

SEQ ID NO: 10813 - RNA, 1701 nt, Artificial Sequence
  derived and/or modified CDS sequence (AUadapt) from InfluenzaA__AGW01965__HA
augaagaccaucaucgcccugucguacauccucugccugguguucgcccaggagcugcccggcaacgacgacuccauggcgacccucugccuggggcaccacgccgucccgaacggcacgaucgugaagaccaucaccaacgaccagaucgaggugaccaacgccacggagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacccuggaguucaacaacgagucguucaacuggacgggggugacccagaacggcaccuccucggccugcauccgccgguccaacaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccucggggcggaucaccguguccaccaagcgcagccagcaggccgugaucccgaacaucggcucgcggccccgcguccggaacauccccucccgcgugagcaucuacuggacgaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacccaggccgccaucgaccagaucaacgggaagcugaaccgccucaucggcaagacgaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucaccgacucggagaugaacaagcuguucgagaagacgaagaagcagcugcgcgagaacgccgaggacauggggaacggcugcuucaagaucuaccacaagugcgacaacgacugcaucggguccauccgcaacggcaccuacgaccacaacguguaccgggacgaggcccucaacaaccgcuuccagaucaaggggaucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 10814 - RNA, 1701 nt, Artificial Sequence; identical to SEQ ID NO: 162
  derived and/or modified CDS sequence (AUadapt) from InfluenzaA__AGW01977__HA

SEQ ID NO: 10815 - RNA, 1701 nt, Artificial Sequence; identical to SEQ ID NO: 162
  derived and/or modified CDS sequence (AUadapt) from InfluenzaA__AGW01989__HA

SEQ ID NO: 10816 - RNA, 1701 nt, Artificial Sequence; identical to SEQ ID NO: 162
  derived and/or modified CDS sequence (AUadapt) from InfluenzaA__AGW02001__HA

SEQ ID NO: 10817 - RNA, 1701 nt, Artificial Sequence; identical to SEQ ID NO: 162
  derived and/or modified CDS sequence (AUadapt) from InfluenzaA__AGW02013__HA

SEQ ID NO: 10818 - RNA, 1701 nt, Artificial Sequence; identical to SEQ ID NO: 10103
  derived and/or modified CDS sequence (AUadapt) from InfluenzaA__AGW02025__HA

SEQ ID NO: 10819 - RNA, 1701 nt, Artificial Sequence; identical to SEQ ID NO: 162
  derived and/or modified CDS sequence (AUadapt) from InfluenzaA__AGW02037__HA

SEQ ID NO: 10820 - RNA, 1701 nt, Artificial Sequence; identical to SEQ ID NO: 162
  derived and/or modified CDS sequence (AUadapt) from InfluenzaA__AGW02061__HA

SEQ ID NO: 10821 - RNA, 1701 nt, Artificial Sequence; identical to SEQ ID NO: 162
  derived and/or modified CDS sequence (AUadapt) from InfluenzaA__AGW02073__HA

SEQ ID NO: 10822 - RNA, 1701 nt, Artificial Sequence; identical to SEQ ID NO: 162
  derived and/or modified CDS sequence (AUadapt) from InfluenzaA__AGW02085__HA

SEQ ID NO: 10823 - RNA, 1701 nt, Artificial Sequence; identical to SEQ ID NO: 10128
  derived and/or modified CDS sequence (AUadapt) from InfluenzaA__AGW02097__HA

SEQ ID NO: 10824 - RNA, 1701 nt, Artificial Sequence; identical to SEQ ID NO: 10103
  derived and/or modified CDS sequence (AUadapt) from InfluenzaA__AGW02109__HA

SEQ ID NO: 10825 - RNA, 1701 nt, Artificial Sequence; identical to SEQ ID NO: 162
  derived and/or modified CDS sequence (AUadapt) from InfluenzaA__AGW02133__HA

SEQ ID NO: 10826 - RNA, 1701 nt, Artificial Sequence; identical to SEQ ID NO: 162
  derived and/or modified CDS sequence (AUadapt) from InfluenzaA__AGW02157__HA

SEQ ID NO: 10827 - RNA, 1701 nt, Artificial Sequence; identical to SEQ ID NO: 10103
  derived and/or modified CDS sequence (AUadapt) from InfluenzaA__AGW02169__HA

SEQ ID NO: 10828 - RNA, 1701 nt, Artificial Sequence; identical to SEQ ID NO: 162
  derived and/or modified CDS sequence (AUadapt) from InfluenzaA__AGW02181__HA

SEQ ID NO: 10829 - RNA, 1701 nt, Artificial Sequence; identical to SEQ ID NO: 10113
  derived and/or modified CDS sequence (AUadapt) from InfluenzaA__AGW02193__HA

SEQ ID NO: 10830 - RNA, 1701 nt, Artificial Sequence; identical to SEQ ID NO: 10080
  derived and/or modified CDS sequence (AUadapt) from InfluenzaA__AGW04171__HA

SEQ ID NO: 10831 - RNA, 1707 nt, Artificial Sequence
  derived and/or modified CDS sequence (AUadapt) from InfluenzaA__AGW27061__HA
auggagaagaucgugcugcuguucgccaucgucaaccuggucaagucggaccacaucugcaucggcuaccacgccaacaacuccaccgagcaggucgacaccaucauggagaagaacgugacggugacccacgcgcaggacauccuggagaagacccacaacgggaagcucugcgaccugaacggcgugaagccccugauccucaaggacugcagcguggccggguggcugcugggcaacccgaugugcgacgaguucaucgacgugcccgagugguccuacaucguggagaaggccaaccccgccaacgaccucugcuaccccgggaacuucaacgacuacgaggagcugaagcaccuccucucgcgcaucaaccacuucgagaagauccggaucaucccgaaggacuccuggcccgaccacgaggccagccugggcgucuccgcggccugcagcuaccagggcaacuccucguucuuccgcaacgugguguggcugcucaagaagaacgacgccuaccccaucaucaagaaguccuacaacaacaccaacaaggaggaccugcugguccucugggggauccaccaccccaacgacgaggccgagcagauccggcuguaccagaacccgacgaccuacgugagcaccggcaccuccacgcugaaccagcgccucgugccccggaucgcgacccgcucgaaggucaacgggcaguccggccggaucgacuucuucuggaccauccugaagcccaacgacgccaucaacuucgagagcaacgggaacuucaucgcccccgaguacgccuacaagaucgugaagaagggcgacuccaccaucaugcgcagcgagguggaguacggcaacugcuccacgcggugccagaccccgaugggggccaucaacucgagcaugcccuuccacaacauccacccccugaccaucggcgagugccccaaguacgucaaguccaacaagcucgugcuggcgaccgggcugcgcaacagcccgcagaucgagcggcgccggcgcaagcggggccucuucggcgccaucgccggguucaucgagggcggguggcagggcaugguggacgggugguacggcuaccaccacuccaacgagcagggcucgggguacgccgccgacaaggaguccacgcagaaggcgaucgacggcgucaccaacaaggugaacagcaucaucgacaagaugaacacccaguucgaggccguggggcgcgaguucaacaaccuggagcggcgcaucgagaaccugaacaagaagauggaggacggcuuccucgacgucuggaccuacaacgccgagcugcuggugcucauggagaacgagcggacgcuggacuuccacgacuccaacgucaagaaccuguacgacaaggugcgccuccagcugcgggacaacgccaaggagcuggggaacggcugcuucgaguucuaccacaagugcgacaacgagugcauggagucggugcgcaacggcaccuacgacuacccccaguacuccgaggaggcccgccucaagcgggaggagaucagcggggucaagcuggaguccaucggcaccuaccagauccugagcaucuacuccaccguggcgucgucccucgugcugagcaucauggucgccgggcugucccucuggaugugcagcaacggcucccugcagugccgcaugugcaucuga

SEQ ID NO: 10832 - RNA, 1698 nt, Artificial Sequence
  derived and/or modified CDS sequence (AUadapt) from InfluenzaA__AGY14471__HA
augaaggugaagcugcucauccugcugugcaccuucaccgccacguacgccgacaccaucugcaucggcuaccacgcgaacaacucgaccgacaccgucgacacgauccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcggccuccugauccccaaggagagcugguccuacaucguggagacccccaaccccgagaacggcacgugcuacccgggguacuucgacgacuacgaggagcugcgcgagcagcucagcuccgucagcuccuucgagcgguucgagaucuuccccaaggagagcuccuggcccaaccacaccgugaccggcgugucggccuccugcagccacaacgggaaguccagcuucuaccgcaaccugcuguggcucaccggcaagaacgggcuguaccccaaccuguccaagagcuacgccaacaacaaggagaaggagguccucauccuguggggcgugcaccacccguccaacaucggcaaccagcggacgcuguaccacaccgagaacaccuacgugagcgucgugagcucccacuacucgcgccgguucacccccgagaucacgaagcgccccaaggugcgggaccaggaggggcgcaucaacuacuacuggacccuccuggagcccggcgacaccaucaucuucgaggccaacgggaaccugaucgccccgugguacgccuucgcccucuccaagggcuucggcagcgggaucaucaccuccaacgcgcccauggacgagugcgacgccaagugccagacgccccagggcgccaucaacagcaaccugcccuuccagaacguccacccggugaccaucggggagugccccaaguacgugcgguccaccaagcugcgcauggucaccggccuccggaacauccccagcauccagucccgcgggcuguucggcgccaucgccggcuucaucgagggcggguggacggggaugguggacggcugguacggguaccaccaccagaacgagcagggcagcggcuacgcggccgaccaggaguccacccagaacgccaucaacgggaucaccaacaaggugaacagcgucaucgagaagaugaacacccaguucacgguggugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgucaugaaccuguacgagaaggugaagggccagcugaagaacaacgccaaggagaucgggaacggcugcuucgaguucuaccacaagugcaacaacgagugcauggagucggugaagaacggcaccuacgacuaccccaaguacuccgaggagagcaagcucaaccgcgagaagaucgacggggucaagcuggaguccaugggcguguaccagauccuggcgaucuacagcacgguggccuccagccucguccugcuggugagccucggggccaucuccuucuggaugugcagcaacggcucccugcagugccggaucugcaucuga

SEQ ID NO: 10833 - RNA, 1698 nt, Artificial Sequence; identical to SEQ ID NO: 10832
  derived and/or modified CDS sequence (AUadapt) from InfluenzaA__AGY14477__HA

SEQ ID NO: 10834 - RNA, 1701 nt, Artificial Sequence
  derived and/or modified CDS sequence (AUadapt) from InfluenzaA__AHC57459__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcauccggaacauccccucgcgcgucuccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 10835 - RNA, 1701 nt, Artificial Sequence; identical to SEQ ID NO: 7227
  derived and/or modified CDS sequence (AUadapt) from InfluenzaA__AHC57465__HA

SEQ ID NO: 10836 - RNA, 1701 nt, Artificial Sequence; identical to SEQ ID NO: 7100
  derived and/or modified CDS sequence (AUadapt) from InfluenzaA__AHC57487__HA

SEQ ID NO: 10837 - RNA, 1701 nt, Artificial Sequence; identical to SEQ ID NO: 8027
  derived and/or modified CDS sequence (AUadapt) from InfluenzaA__AHC57499__HA

SEQ ID NO: 10838 - RNA, 1701 nt, Artificial Sequence; identical to SEQ ID NO: 8027
  derived and/or modified CDS sequence (AUadapt) from InfluenzaA__AHC57511__HA

SEQ ID NO: 10839 - RNA, 1701 nt, Artificial Sequence; identical to SEQ ID NO: 8027
  derived and/or modified CDS sequence (AUadapt) from InfluenzaA__AHC57523__HA

SEQ ID NO: 10840 - RNA, 1701 nt, Artificial Sequence; identical to SEQ ID NO: 7227
  derived and/or modified CDS sequence (AUadapt) from InfluenzaA__AHC57675__HA

SEQ ID NO: 10841 - RNA, 1701 nt, Artificial Sequence; identical to SEQ ID NO: 7227
  derived and/or modified CDS sequence (AUadapt) from InfluenzaA__AHC57827__HA

SEQ ID NO: 10842 - RNA, 1701 nt, Artificial Sequence; identical to SEQ ID NO: 7100
  derived and/or modified CDS sequence (AUadapt) from InfluenzaA__AHC57956__HA

SEQ ID NO: 10843 - RNA, 1701 nt, Artificial Sequence
  derived and/or modified CDS sequence (AUadapt) from InfluenzaA__AHC57981__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcgacagcccccaccagauccuggacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccugaucgccuccucgggcacgcucgaguucaacaacgaguccuucaacuggaccggggucacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccuccgggcggaucaccgucagcacgaagcgcucccagcaggccgugaucccgaacaucggcucgcggccccgcgugcggaacauccccucgcgcaucuccaucuacuggaccaucgucaagcccggcgacauccugcugaucaacagcaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaaccugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacguguaccgggacgaggcccugaacaaccgcuuccagaucaagggggucgagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 10844 - RNA, 1701 nt, Artificial Sequence; identical to SEQ ID NO: 8027
  derived and/or modified CDS sequence (AUadapt) from InfluenzaA__AHC57993__HA

SEQ ID NO: 10845 - RNA, 1701 nt, Artificial Sequence; identical to SEQ ID NO: 9319
  derived and/or modified CDS sequence (AUadapt) from InfluenzaA__AHC58005__HA

SEQ ID NO: 10846 - RNA, 1701 nt, Artificial Sequence
  derived and/or modified CDS sequence (AUadapt) from InfluenzaA__AHC58017__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcucgcggccccgcguccggaacauccccagccgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgugucgauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggcccugcucggcuucaucaugugggccugccagaagggcaacauccggugcaacaucugcaucuga

SEQ ID NO: 10847 - RNA, 1701 nt, Artificial Sequence
  derived and/or modified CDS sequence (AUadapt) from InfluenzaA__AHC58029__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcagcugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 10848 - RNA, 1701 nt, Artificial Sequence
  derived and/or modified CDS sequence (AUadapt) from InfluenzaA__AHC58050__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgcgccggucccagcaggccgugaucccgaacaucggcagccgcccccggauccgcaacauccccucccggaucucgaucuacuggaccaucgucaagcccggcgacauccugcucaucaacuccaccgggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgugaaccggaucacguacggggccugcccccgcuacgugaagcagucgacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacgcaggcggccaucgaccagaucaacgggaagcugaaccggcucaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 10849 - RNA, 1701 nt, Artificial Sequence; identical to SEQ ID NO: 8027
  derived and/or modified CDS sequence (AUadapt) from InfluenzaA__AHC58074__HA

SEQ ID NO: 10850 - RNA, 1701 nt, Artificial Sequence; identical to SEQ ID NO: 8027
  derived and/or modified CDS sequence (AUadapt) from InfluenzaA__AHC58098__HA

SEQ ID NO: 10851 - RNA, 1701 nt, Artificial Sequence; identical to SEQ ID NO: 8027
  derived and/or modified CDS sequence (AUadapt) from InfluenzaA__AHC58110__HA

SEQ ID NO: 10852 - RNA, 1701 nt, Artificial Sequence; identical to SEQ ID NO: 8027
  derived and/or modified CDS sequence (AUadapt) from InfluenzaA__AHC58126__HA

SEQ ID NO: 10853 - RNA, 1701 nt, Artificial Sequence; identical to SEQ ID NO: 8027
  derived and/or modified CDS sequence (AUadapt) from InfluenzaA__AHC58138__HA

SEQ ID NO: 10854 - RNA, 1701 nt, Artificial Sequence; identical to SEQ ID NO: 8027
  derived and/or modified CDS sequence (AUadapt) from InfluenzaA__AHC58162__HA

SEQ ID NO: 10855 - RNA, 1701 nt, Artificial Sequence; identical to SEQ ID NO: 9319
  derived and/or modified CDS sequence (AUadapt) from InfluenzaA__AHC58186__HA

SEQ ID NO: 10856 - RNA, 1701 nt, Artificial Sequence
  derived and/or modified CDS sequence (AUadapt) from InfluenzaA__AHC58198__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccagaaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggacugccagaaggggaacauccggugcaacaucugcaucuga

SEQ ID NO: 10857 - RNA, 1701 nt, Artificial Sequence
  derived and/or modified CDS sequence (AUadapt) from InfluenzaA__AHC58210__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacugggccggggugacccagaacggcaccucguccgccugcauccgccggagcaacaacuccuucuucucgcgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccuccgggcggaucaccgugagcaccaagcgcucccagcaggccgugaucccgaacaucggcucgcggccccgcguccggaacauccccucgcgcaucuccaucuacuggacgaucgugaagcccggcgacauccugcucaucaacagcaccgggaaccugaucgccccgcggggcuacuucaagauccgcuccggcaagucguccaucaugcggagcgacgcgcccaucgggaagugcaacuccgagugcaucacccccaacggcucgauccccaacgacaagccguuccagaacgugaaccgcaucaccuacggggccugcccccgguacgucaagcagaacacgcugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccucaagucgacccaggccgccaucgaccagaucaacgggaagcugaaccgccugaucggcaagacgaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 10858 - RNA, 1701 nt, Artificial Sequence; identical to SEQ ID NO: 7227
  derived and/or modified CDS sequence (AUadapt) from InfluenzaA__AHC58234__HA

SEQ ID NO: 10859 - RNA, 1701 nt, Artificial Sequence; identical to SEQ ID NO: 8027
  derived and/or modified CDS sequence (AUadapt) from InfluenzaA__AHC58246__HA

SEQ ID NO: 10860 - RNA, 1701 nt, Artificial Sequence; identical to SEQ ID NO: 7227
  derived and/or modified CDS sequence (AUadapt) from InfluenzaA__AHC58258__HA

SEQ ID NO: 10861 - RNA, 1701 nt, Artificial Sequence; identical to SEQ ID NO: 7100
  derived and/or modified CDS sequence (AUadapt) from InfluenzaA__AHC58270__HA

SEQ ID NO: 10862 - RNA, 1701 nt, Artificial Sequence
  derived and/or modified CDS sequence (AUadapt) from InfluenzaA__AHC58372__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacucguccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcggaucaccgugagcacgaagcgcucccagcaggccgugaccccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgugaagcagagcacccugaagcucgcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggucguacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacaaccacgacguguaccgggacgaggcccucaacaaccgcuuccagaucaagggggucgagcugaaguccggcuacaaggacuggauccuguggaucucguucgccaucagcugcuuccuccugugcguggcccugcucggcuucaucaugugggccugccagaaggggaacauccggugcaacaucugcaucuga

SEQ ID NO: 10863 - RNA, 1701 nt, Artificial Sequence
  derived and/or modified CDS sequence (AUadapt) from InfluenzaA__AHC58396__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 10864 - RNA, 1701 nt, Artificial Sequence; identical to SEQ ID NO: 8027
  derived and/or modified CDS sequence (AUadapt) from InfluenzaA__AHC58408__HA

SEQ ID NO: 10865 - RNA, 1701 nt, Artificial Sequence; identical to SEQ ID NO: 9319
  derived and/or modified CDS sequence (AUadapt) from InfluenzaA__AHC58420__HA

SEQ ID NO: 10866 - RNA, 1701 nt, Artificial Sequence; identical to SEQ ID NO: 9319
  derived and/or modified CDS sequence (AUadapt) from InfluenzaA__AHC58432__HA

SEQ ID NO: 10867 - RNA, 1701 nt, Artificial Sequence; identical to SEQ ID NO: 7227
  derived and/or modified CDS sequence (AUadapt) from InfluenzaA__AHC58444__HA

SEQ ID NO: 10868 - RNA, 1701 nt, Artificial Sequence; identical to SEQ ID NO: 10863
  derived and/or modified CDS sequence (AUadapt) from InfluenzaA__AHC58456__HA

SEQ ID NO: 10869 - RNA, 1701 nt, Artificial Sequence
  derived and/or modified CDS sequence (AUadapt) from InfluenzaA__AHC58468__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcaggccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgucaucgagaagaugaacacccaguucacggccgugggcaaggaguucaaccaccuggagcggcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgggaggagaucgacggcgugaagcuggagagcacccgcaucuaccagauccuggccaucuacuccaccgucgccucgagccucgugcugguggucucccugggggccaucucguucuggaugugcuccaacggcagccuccagugccggaucugcaucuga

SEQ ID NO: 10870 - RNA, 1701 nt, Artificial Sequence
  derived and/or modified CDS sequence (AUadapt) from InfluenzaA__AHC58479__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucaaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuucaagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 10871 - RNA, 1701 nt, Artificial Sequence; identical to SEQ ID NO: 10863
  derived and/or modified CDS sequence (AUadapt) from InfluenzaA__AHC58491__HA

SEQ ID NO: 10872 - RNA, 1701 nt, Artificial Sequence; identical to SEQ ID NO: 7227
  derived and/or modified CDS sequence (AUadapt) from InfluenzaA__AHC58515__HA

SEQ ID NO: 10873 - RNA, 1701 nt, Artificial Sequence; identical to SEQ ID NO: 8027
  derived and/or modified CDS sequence (AUadapt) from InfluenzaA__AHC58527__HA

SEQ ID NO: 10874 - RNA, 1701 nt, Artificial Sequence
  derived and/or modified CDS sequence (AUadapt) from InfluenzaA__AHC58563__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 10875 - RNA, 1701 nt, Artificial Sequence; identical to SEQ ID NO: 8027
  derived and/or modified CDS sequence (AUadapt) from InfluenzaA__AHC58575__HA

SEQ ID NO: 10876 - RNA, 1701 nt, Artificial Sequence; identical to SEQ ID NO: 7100
  derived and/or modified CDS sequence (AUadapt) from InfluenzaA__AHC58587__HA

SEQ ID NO: 10877 - RNA, 1701 nt, Artificial Sequence; identical to SEQ ID NO: 7227
  derived and/or modified CDS sequence (AUadapt) from InfluenzaA__AHC58599__HA

SEQ ID NO: 10878 - RNA, 1701 nt, Artificial Sequence; identical to SEQ ID NO: 8027
  derived and/or modified CDS sequence (AUadapt) from InfluenzaA__AHC58611__HA

SEQ ID NO: 10879 - RNA, 1701 nt, Artificial Sequence; identical to SEQ ID NO: 8027
  derived and/or modified CDS sequence (AUadapt) from InfluenzaA__AHC58623__HA

SEQ ID NO: 10880 - RNA, 1701 nt, Artificial Sequence; identical to SEQ ID NO: 8027
  derived and/or modified CDS sequence (AUadapt) from InfluenzaA__AHC58647__HA

SEQ ID NO: 10881 - RNA, 1701 nt, Artificial Sequence; identical to SEQ ID NO: 7227
  derived and/or modified CDS sequence (AUadapt) from InfluenzaA__AHC58659__HA

SEQ ID NO: 10882 - RNA, 1701 nt, Artificial Sequence; identical to SEQ ID NO: 7100
  derived and/or modified CDS sequence (AUadapt) from InfluenzaA__AHC58671__HA

SEQ ID NO: 10883 - RNA, 1701 nt, Artificial Sequence; identical to SEQ ID NO: 9319
  derived and/or modified CDS sequence (AUadapt) from InfluenzaA__AHC58683__HA

SEQ ID NO: 10884 - RNA, 1701 nt, Artificial Sequence; identical to SEQ ID NO: 7100
  derived and/or modified CDS sequence (AUadapt) from InfluenzaA__AHC58695__HA

SEQ ID NO: 10885 - RNA, 1701 nt, Artificial Sequence; identical to SEQ ID NO: 9319
  derived and/or modified CDS sequence (AUadapt) from InfluenzaA__AHC58707__HA

SEQ ID NO: 10886 - RNA, 1701 nt, Artificial Sequence; identical to SEQ ID NO: 9319
  derived and/or modified CDS sequence (AUadapt) from InfluenzaA__AHC58719__HA

SEQ ID NO: 10887 - RNA, 1701 nt, Artificial Sequence; identical to SEQ ID NO: 10863
  derived and/or modified CDS sequence (AUadapt) from InfluenzaA__AHC58731__HA

SEQ ID NO: 10888 - RNA, 1701 nt, Artificial Sequence
  derived and/or modified CDS sequence (AUadapt) from InfluenzaA__AHC58743__HA
augaagaccaucaucgccuggucguacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcgacagcccccaccagauccuggacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 10889 - RNA, 1701 nt, Artificial Sequence; identical to SEQ ID NO: 10863
  derived and/or modified CDS sequence (AUadapt) from InfluenzaA__AHC58755__HA

SEQ ID NO: 10890 - RNA, 1701 nt, Artificial Sequence; identical to SEQ ID NO: 7100
  derived and/or modified CDS sequence (AUadapt) from InfluenzaA__AHC58779__HA

SEQ ID NO: 10891 - RNA, 1701 nt, Artificial Sequence; identical to SEQ ID NO: 10862
  derived and/or modified CDS sequence (AUadapt) from InfluenzaA__AHC58791__HA

SEQ ID NO: 10892 - RNA, 1701 nt, Artificial Sequence
  derived and/or modified CDS sequence (AUadapt) from InfluenzaA__AHC58803__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugaaguccgacgcccccaucgggaagugcaacagcgagugcaucacccccaacggcucgauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgcggaccucaagucgacgcaggccgccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgggagaacgcggaggacauggggaacggcugcuucaagaucuaccacaagugcgacaacgccugcaucgggucgauccgcaacggcaccuacgaccacgacgucuaccgcgacgaggcccugaacaaccgguucaagaucaaggggguggagcucaaguccggcuacaaggacuggauccuguggaucagcuucgccaucuccugcuuccugcucugcguggcccugcugggcuucaucaugugggcgugccagaaggggaacauccgcugcaacaucugcaucuga

SEQ ID NO: 10893 - RNA, 1701 nt, Artificial Sequence
  derived and/or modified CDS sequence (AUadapt) from InfluenzaA__AHC58815__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgggaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucgggccggaucaccguguccacgaagcgcagccagcaggccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacccccaacggguccauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacucggagggccgggggcaggccgcggaccugaaguccacgcaggccgccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacaacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 10894 - RNA, 1701 nt, Artificial Sequence; identical to SEQ ID NO: 7100
  derived and/or modified CDS sequence (AUadapt) from InfluenzaA__AHC58827__HA

SEQ ID NO: 10895 - RNA, 1701 nt, Artificial Sequence; identical to SEQ ID NO: 8027
  derived and/or modified CDS sequence (AUadapt) from InfluenzaA__AHC58839__HA

SEQ ID NO: 10896 - RNA, 1701 nt, Artificial Sequence
  derived and/or modified CDS sequence (AUadapt) from InfluenzaA__AHC58863__HA
augaagaccaucaucgcccugucguacauccucugccugguguucgcccagaagcugcccggcaacgacaacuccaccgcgacgcucugccuggggcaccacgccgucucgaacggcaccaucgugaagaccaucaccaacgaccagaucgaggugacgaacgccaccgagcugguccaguccagcuccaccggggagaucugcaacucgccgcaccagauccucgacggcgagaacugcacccugaucgacgcccugcucggggacccccagugcgacggcuuccagaacaagaagugggaccuguucguggagcgcuccaaggcccacagcaacugcuaccccuacgacgugcccgacuacgcgucccugcggucgcucgucgccuccagcggcacgcuggaguucaacaacgaguccuucaacuggaccggggugacccagaacggcaccucguccgccugcauccgcgggucgaacaacuccuucuucagccggcugaacuggcucacgcaccugaacuucaaguacccggcccugaacgugaccaugcccaacaacgagcaguucgacaagcucuacaucuggggcguccaccaccccgggaccgacaaggaccagaucuuccuguacgcgcaggccuccggccgcaucaccgugucgacgaagcggagccagcaggccgugauccccaacaucggcucccgcccgcggguccgcaacauccccucgcggguguccaucuacuggaccaucgugaagcccggggacauccugcucaucaacagcaccggcaaccugaucgcgccccgcggguacuucaagauccgguccggcaagucguccaucaugcgcucggacgccccgaucggcaagugcaacuccgccugcaucacccccaacgggagcauccccaacgacaagcccuuccagaacgucaaccggaucacguacggcgccugcccgcgcuacgugaagcagaacacccugaagcucgccaccgggaugcggaacgugcccgagaagcagacccgcggcaucuucggggccaucgccggcuucaucgagaacggcugggaggggaugauggacggcugguacggguuccggcaccagaacuccgagggccgcgggcaggcggccgaccucaagucgacgcaggccgccaucgaccagaucaacggcaagcugaaccggcugaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgggagaacgccgaggacaugggcaacgggugcuucaagaucuaccacaagugcgacaacgccugcaucggcucgauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcgcugcucggguucaucaugugggccugccagaagggcaacauccgcugcaacaucugcaucuga

SEQ ID NO: 10897 - RNA, 1701 nt, Artificial Sequence; identical to SEQ ID NO: 7100
  derived and/or modified CDS sequence (AUadapt) from InfluenzaA__AHC58875__HA

SEQ ID NO: 10898 - RNA, 1701 nt, Artificial Sequence; identical to SEQ ID NO: 8027
  derived and/or modified CDS sequence (AUadapt) from InfluenzaA__AHC58887__HA

SEQ ID NO: 10899 - RNA, 1701 nt, Artificial Sequence; identical to SEQ ID NO: 10863
  derived and/or modified CDS sequence (AUadapt) from InfluenzaA__AHC58899__HA

SEQ ID NO: 10900 - RNA, 1701 nt, Artificial Sequence; identical to SEQ ID NO: 8027
  derived and/or modified CDS sequence (AUadapt) from InfluenzaA__AHC58981__HA

SEQ ID NO: 10901 - RNA, 1701 nt, Artificial Sequence; identical to SEQ ID NO: 8027
  derived and/or modified CDS sequence (AUadapt) from InfluenzaA__AHC58993__HA

SEQ ID NO: 10902 - RNA, 1701 nt, Artificial Sequence; identical to SEQ ID NO: 8027
  derived and/or modified CDS sequence (AUadapt) from InfluenzaA__AHC59005__HA

SEQ ID NO: 10903 - RNA, 1701 nt, Artificial Sequence
  derived and/or modified CDS sequence (AUadapt) from InfluenzaA__AHC59017__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcagccgcccccggguccgcaacauccccucccgggugucgaucuacuggaccaucgugaagcccggggacauccugcucaucaacuccaccggcaaccugaucgccccgcgcggguacuucaagauccggagcggcaaguccucgaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacagcgagggccgcgggcaggcggccgaccugaaguccacgcaggccgccaucgaccagaucaacggcaagcugaaccggcucaucggcaagaccaacgagaaguuccaccagaucgagaaggaguucucggagguggaggggcgcauccaggaccuggagaaguacguggaggacaccaagaucgaccugugguccuacaacgccgagcuccuggucgcgcuggagaaccagcacaccaucgaccucacggacagcgagauguccaagcuguucgagaagaccaagaagcagcugcgggagaacgccgaggacaugggcaacgggugcuucaagaucuaccacaagugcgacaacgccugcaucggcucgauccgcaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcgcugcucggguucaucaugugggccugccagaagggcaacauccgcugcaacaucugcaucuga

SEQ ID NO: 10904 - RNA, 1701 nt, Artificial Sequence; identical to SEQ ID NO: 10863
  derived and/or modified CDS sequence (AUadapt) from InfluenzaA__AHC59029__HA

SEQ ID NO: 10905 - RNA, 1701 nt, Artificial Sequence; identical to SEQ ID NO: 7227
  derived and/or modified CDS sequence (AUadapt) from InfluenzaA__AHC59041__HA

SEQ ID NO: 10906 - RNA, 1701 nt, Artificial Sequence
  derived and/or modified CDS sequence (AUadapt) from InfluenzaA__AHC59053__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccaguccgggaaguccuccaucaugcgcagcgacgcgcccaucggcaagugcaacuccgccugcaucacccccaacggcucgauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacuccgaggggcgcggccaggccgccgaccucaagucgacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgccugcaucgggucgauccgcaacggcaccuacgaccacgacguguaccgcgacgaggcccucaacaaccgguuccagaucaaggggguggagcugaaguccggcuacaaggacuggauccuguggaucagcuucgcgaucuccugcuuccuccugugcgucgcccugcucggcuucaucauguggaccugccagaaggggaacauccgcugcaacaucugcaucuga

SEQ ID NO: 10907 - RNA, 1701 nt, Artificial Sequence
  derived and/or modified CDS sequence (AUadapt) from InfluenzaA__AHC59077__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcaggccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugcggucggacgcccccaucgggaagugcaacuccgagugcaucacccccaacggcagcauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcgugguccugcucggcuucaucaugugggccugccagaaggggaacauccggugcaacaucugcaucuga

SEQ ID NO: 10908 - RNA, 1701 nt, Artificial Sequence; identical to SEQ ID NO: 9319
  derived and/or modified CDS sequence (AUadapt) from InfluenzaA__AHC59089__HA

SEQ ID NO: 10909 - RNA, 1701 nt, Artificial Sequence; identical to SEQ ID NO: 8027
  derived and/or modified CDS sequence (AUadapt) from InfluenzaA__AHC59101__HA

SEQ ID NO: 10910 - RNA, 1701 nt, Artificial Sequence; identical to SEQ ID NO: 7227
  derived and/or modified CDS sequence (AUadapt) from InfluenzaA__AHC59113__HA

SEQ ID NO: 10911 - RNA, 1701 nt, Artificial Sequence; identical to SEQ ID NO: 8027
  derived and/or modified CDS sequence (AUadapt) from InfluenzaA__AHC59125__HA

SEQ ID NO: 10912 - RNA, 1701 nt, Artificial Sequence
  derived and/or modified CDS sequence (AUadapt) from InfluenzaA__AHC59137__HA
augaagaccaucaucgcccugucguacauccucugccugguguucgcccagaagauccccggcaacgacaacuccaccgcgacgcugugccucgggcaccacgccgucucgaacggcaccaucgugaagaccaucaccaacgaccagaucgaggugacgaacgccaccgagcugguccaguccagcuccaccggggagaucugcaacucgccgcaccagauccuggacggcgagaacugcacccucaucgacgcccugcugggggacccccagugcgacggcuuccagaacaagaagugggaccucuucguggagcgcuccaaggcccacagcaacugcuaccccuacgacgugcccgacuacgcgucccugcggucgcuggucgccuccagcggcacgcucgaguucaacaacgaguccuucaacuggaccggggugacccagaacggcaccucguccgccugcauccgcgggucgaacaacuccuucuucagccggcugaacuggcugacgcaccucaacuucaaguacccggcccugaacgugaccaugcccaacaacgagcaguucgacaagcuguacaucuggggcguccaccaccccgggaccgacaaggaccagaucuuccucuacgcgcaggccuccggccgcaucaccgugucgacgaagcggagccagcaggccgugauccccaacaucggcucccgcccgcggguccgcaacauccccucgcggguguccaucuacuggaccaucgugaagcccggggacauccugcugaucaacagcaccggcaaccucaucgcgccccgcggguacuucaagauccgguccggcaagucguccaucaugcgcucggacgccccgaucggcaagugcaacuccgccugcaucacccccaacgggagcauccccaacgacaagcccuuccagaacgucaaccggaucacguacggcgccugcccgcgcuacgugaagcagaacacccugaagcuggccaccgggaugcggaacgugcccgagaagcagacccgcggcaucuucggggccaucgccggcuucaucgagaacggcugggaggggaugauggacggcugguacggguuccggcaccagaacuccgagggccgcgggcaggcggccgaccucaagucgacgcaggccgccaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcgcuggagaaccagcacaccaucgaccugacggacuccgagaugaacaagcuguucgagaagaccaagaagcagcuccgggagaacgccgaggacaugggcaacgggugcuucaagaucuaccacaagugcgacaacgccugcaucggcucgauccgcaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcguggcgcugcugggguucaucaugugggccugccagaagggcaacauccgcugcaacaucugcaucuga

SEQ ID NO: 10913 - RNA, 1701 nt, Artificial Sequence; identical to SEQ ID NO: 7227
  derived and/or modified CDS sequence (AUadapt) from InfluenzaA__AHC59149__HA

SEQ ID NO: 10914 - RNA, 1701 nt, Artificial Sequence
  derived and/or modified CDS sequence (AUadapt) from InfluenzaA__AHC59185__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 10915 - RNA, 1701 nt, Artificial Sequence; identical to SEQ ID NO: 7100
  derived and/or modified CDS sequence (AUadapt) from InfluenzaA__AHC59197__HA

SEQ ID NO: 10916 - RNA, 1701 nt, Artificial Sequence
  derived and/or modified CDS sequence (AUadapt) from InfluenzaA__AHC59209__HA
augaagaccaucaucgcccugucguacauccucugccugguguucgcccaggagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacgacuuccagaacaagaagugggaccucuucguggagcgcuccaaggcccacuccaacugcuaccccuacgacgugccggacuacgcgucgcugcggucccuggucgccagcuccggcacgcucgaguucaacaacgagucguucaacuggaccggcgugacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucgggccggaucaccguguccacgaagcgcagccagcaggccgugaucccgaacaucgggucgcggccccgcguccggaacauccccucccgcgugucgaucuacuggaccaucgugaagcccggcgacauccugcugaucaacuccaccggcaaccucaucgccccgcggggguacuucaagauccgcagcggcaaguccucgaucaugcgguccgacgcccccaucggggagugcaacagcgcgugcaucacccccaacggcuccauccccaacgacaagccguuccagaacgucaaccgcaucacguacggcgccugcccccgguacgugaagcagaacacccugaagcuggccaccgggaugcgcaacgugcccgagaagcagacccggggcaucuucggggccaucgccggcuucaucgagaacgggugggagggcauggucgacggcugguacggguuccgccaccagaacucggagggccgggggcaggcggccgaccucaaguccacgcaggccgccaucgaccagaucaacggcaagcugaaccgccugaucgggaagaccaacgagaaguuccaccagaucgagaaggaguucucggagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgccguguaccgggacgaggcccugaacaaccgcuuccagaucaagggcguggagcucaagucgggguacaaggacuggauccuguggaucuccuucgcgaucagcugcuuccugcucugcgucgcccugcugggcuucaucaugugggccugccagaagggcaacauccggugcaacaucugcaucuga

SEQ ID NO: 10917 - RNA, 1701 nt, Artificial Sequence; identical to SEQ ID NO: 7227
  derived and/or modified CDS sequence (AUadapt) from InfluenzaA__AHC59221__HA

SEQ ID NO: 10918 - RNA, 1701 nt, Artificial Sequence; identical to SEQ ID NO: 10896
  derived and/or modified CDS sequence (AUadapt) from InfluenzaA__AHC59245__HA

SEQ ID NO: 10919 - RNA, 1701 nt, Artificial Sequence; identical to SEQ ID NO: 10863
  derived and/or modified CDS sequence (AUadapt) from InfluenzaA__AHC59257__HA

SEQ ID NO: 10920 - RNA, 1701 nt, Artificial Sequence; identical to SEQ ID NO: 8027
  derived and/or modified CDS sequence (AUadapt) from InfluenzaA__AHC59269__HA

SEQ ID NO: 10921 - RNA, 1701 nt, Artificial Sequence; identical to SEQ ID NO: 10863
  derived and/or modified CDS sequence (AUadapt) from InfluenzaA__AHC59281__HA

SEQ ID NO: 10922 - RNA, 1701 nt, Artificial Sequence; identical to SEQ ID NO: 7227
  derived and/or modified CDS sequence (AUadapt) from InfluenzaA__AHC59293__HA

SEQ ID NO: 10923 - RNA, 1701 nt, Artificial Sequence
  derived and/or modified CDS sequence (AUadapt) from InfluenzaA__AHC59305__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcuccucgccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcagccagcaggccgugaucccgaacaucggcucccggccccgcguccggaacauccccucgcgcguguccaucuacuggaccaucgugaagcccggcgacauccugcucaucaacagcaccgggaaccugaucgccccgcggggcuacuucaagauccgcuccggcaagucguccaucaugcggucggacgcccccaucgggaagugcaacuccgcgugcaucacccccaacggcagcauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 10924 - RNA, 1701 nt, Artificial Sequence
  derived and/or modified CDS sequence (AUadapt) from InfluenzaA__AHC59329__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgagaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 10925 - RNA, 1701 nt, Artificial Sequence; identical to SEQ ID NO: 9319
  derived and/or modified CDS sequence (AUadapt) from InfluenzaA__AHC59341__HA

SEQ ID NO: 10926 - RNA, 1701 nt, Artificial Sequence; identical to SEQ ID NO: 10863
  derived and/or modified CDS sequence (AUadapt) from InfluenzaA__AHC59365__HA

SEQ ID NO: 10927 - RNA, 1701 nt, Artificial Sequence
  derived and/or modified CDS sequence (AUadapt) from InfluenzaA__AHC59377__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgucccggacuacgcgucccugcggagccucguggccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccuccgggcggaucaccgugagcacgaagcgcucccagcaggccgucaucccgaacaucggcucgcggccccgcgugcggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccagaaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggcgugccagaaggggaacauccggugcaacaucugcaucuga

SEQ ID NO: 10928 - RNA, 1701 nt, Artificial Sequence; identical to SEQ ID NO: 7227
  derived and/or modified CDS sequence (AUadapt) from InfluenzaA__AHC59413__HA

SEQ ID NO: 10929 - RNA, 1701 nt, Artificial Sequence; identical to SEQ ID NO: 8027
  derived and/or modified CDS sequence (AUadapt) from InfluenzaA__AHC59425__HA

SEQ ID NO: 10930 - RNA, 1701 nt, Artificial Sequence; identical to SEQ ID NO: 9319
  derived and/or modified CDS sequence (AUadapt) from InfluenzaA__AHC59437__HA

SEQ ID NO: 10931 - RNA, 1701 nt, Artificial Sequence
  derived and/or modified CDS sequence (AUadapt) from InfluenzaA__AHC59449__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacucggagggccgcgggcaggcggccgaccugaaguccacgcaggccgccaucgaccagaucaacggcaagcugaaccggcucaucggccgcaccaacgagaaguuccaccagaucgagaaggaguucagcgagguggaggggcggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcgcugcucggguucaucaugugggccugccagaagggcaacauccggugcaacaucugcaucuga

SEQ ID NO: 10932 - RNA, 1701 nt, Artificial Sequence; identical to SEQ ID NO: 7100
  derived and/or modified CDS sequence (AUadapt) from InfluenzaA__AHC59461__HA

SEQ ID NO: 10933 - RNA, 1701 nt, Artificial Sequence; identical to SEQ ID NO: 10924
  derived and/or modified CDS sequence (AUadapt) from InfluenzaA__AHC59473__HA

SEQ ID NO: 10934 - RNA, 1701 nt, Artificial Sequence; identical to SEQ ID NO: 7227
  derived and/or modified CDS sequence (AUadapt) from InfluenzaA__AHC59485__HA

SEQ ID NO: 10935 - RNA, 1701 nt, Artificial Sequence; identical to SEQ ID NO: 7227
  derived and/or modified CDS sequence (AUadapt) from InfluenzaA__AHC59497__HA

SEQ ID NO: 10936 - RNA, 1701 nt, Artificial Sequence; identical to SEQ ID NO: 7100
  derived and/or modified CDS sequence (AUadapt) from InfluenzaA__AHC59509__HA

SEQ ID NO: 10937 - RNA, 1701 nt, Artificial Sequence; identical to SEQ ID NO: 7100
  derived and/or modified CDS sequence (AUadapt) from InfluenzaA__AHC59521__HA

SEQ ID NO: 10938 - RNA, 1701 nt, Artificial Sequence
  derived and/or modified CDS sequence (AUadapt) from InfluenzaA__AHC59533__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaagaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10939 - RNA, 1701 nt, Artificial Sequence; identical to SEQ ID NO: 7227
  derived and/or modified CDS sequence (AUadapt) from InfluenzaA__AHC59545__HA

SEQ ID NO: 10940 - RNA, 1701 nt, Artificial Sequence; identical to SEQ ID NO: 10863
  derived and/or modified CDS sequence (AUadapt) from InfluenzaA__AHC59557__HA

SEQ ID NO: 10941 - RNA, 1701 nt, Artificial Sequence
  derived and/or modified CDS sequence (AUadapt) from InfluenzaA__AHC59569__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 10942 - RNA, 1701 nt, Artificial Sequence; identical to SEQ ID NO: 7227
  derived and/or modified CDS sequence (AUadapt) from InfluenzaA__AHC59581__HA

SEQ ID NO: 10943 - RNA, 1701 nt, Artificial Sequence; identical to SEQ ID NO: 7100
  derived and/or modified CDS sequence (AUadapt) from InfluenzaA__AHC59593__HA

SEQ ID NO: 10944 - RNA, 1701 nt, Artificial Sequence; identical to SEQ ID NO: 9319
  derived and/or modified CDS sequence (AUadapt) from InfluenzaA__AHC59605__HA

SEQ ID NO: 10945 - RNA, 1701 nt, Artificial Sequence; identical to SEQ ID NO: 7227
  derived and/or modified CDS sequence (AUadapt) from InfluenzaA__AHC59617__HA

SEQ ID NO: 10946 - RNA, 1701 nt, Artificial Sequence; identical to SEQ ID NO: 7227
  derived and/or modified CDS sequence (AUadapt) from InfluenzaA__AHC59629__HA

SEQ ID NO: 10947 - RNA, 1701 nt, Artificial Sequence; identical to SEQ ID NO: 10863
  derived and/or modified CDS sequence (AUadapt) from InfluenzaA__AHC59641__HA

SEQ ID NO: 10948 - RNA, 1701 nt, Artificial Sequence
  derived and/or modified CDS sequence (AUadapt) from InfluenzaA__AHC59653__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgcagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 10949 - RNA, 1701 nt, Artificial Sequence; identical to SEQ ID NO: 7100
  derived and/or modified CDS sequence (AUadapt) from InfluenzaA__AHC59665__HA

SEQ ID NO: 10950 - RNA, 1701 nt, Artificial Sequence; identical to SEQ ID NO: 7227
  derived and/or modified CDS sequence (AUadapt) from InfluenzaA__AHC59677__HA

SEQ ID NO: 10951 - RNA, 1701 nt, Artificial Sequence; identical to SEQ ID NO: 10948
  derived and/or modified CDS sequence (AUadapt) from InfluenzaA__AHC59689__HA

SEQ ID NO: 10952 - RNA, 1701 nt, Artificial Sequence; identical to SEQ ID NO: 10863
  derived and/or modified CDS sequence (AUadapt) from InfluenzaA__AHC59701__HA

SEQ ID NO: 10953 - RNA, 1701 nt, Artificial Sequence; identical to SEQ ID NO: 7100
  derived and/or modified CDS sequence (AUadapt) from InfluenzaA__AHC59713__HA

SEQ ID NO: 10954 - RNA, 1701 nt, Artificial Sequence; identical to SEQ ID NO: 10874
  derived and/or modified CDS sequence (AUadapt) from InfluenzaA__AHC59737__HA

SEQ ID NO: 10955 - RNA, 1701 nt, Artificial Sequence; identical to SEQ ID NO: 7100
  derived and/or modified CDS sequence (AUadapt) from InfluenzaA__AHC59749__HA

SEQ ID NO: 10956 - RNA, 1701 nt, Artificial Sequence; identical to SEQ ID NO: 7227
  derived and/or modified CDS sequence (AUadapt) from InfluenzaA__AHC59761__HA

SEQ ID NO: 10957 - RNA, 1701 nt, Artificial Sequence; identical to SEQ ID NO: 7227
  derived and/or modified CDS sequence (AUadapt) from InfluenzaA__AHC59773__HA

SEQ ID NO: 10958 - RNA, 1701 nt, Artificial Sequence; identical to SEQ ID NO: 8027
  derived and/or modified CDS sequence (AUadapt) from InfluenzaA__AHC59785__HA

SEQ ID NO: 10959 - RNA, 1701 nt, Artificial Sequence; identical to SEQ ID NO: 7227
  derived and/or modified CDS sequence (AUadapt) from InfluenzaA__AHC59797__HA

SEQ ID NO: 10960 - RNA, 1701 nt, Artificial Sequence; identical to SEQ ID NO: 9319
  derived and/or modified CDS sequence (AUadapt) from InfluenzaA__AHC59809__HA

SEQ ID NO: 10961 - RNA, 1701 nt, Artificial Sequence
  derived and/or modified CDS sequence (AUadapt) from InfluenzaA__AHC59821__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacucgccccaccagauccucgacggcgagaacugcacccugaucgacgcccugcucggggacccccagugcgacggccugcagaacaagaagugggaccuguucguggagcgcuccaaggccuacagcaacugcuaccccuacgacgugccggacuacgcgucccuccggucgcuggucgccuccucgggcacgcuggaguucaacaacgaguccuucaacuggaccggggugacccagaacggcaccagcuccgccugcauccgccggucgaacaacuccuucuucucgcgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccuccugaucaacucgaccgggaaccugaucgccccgcggggcuacuucaagauccgcuccggcaagagcuccaucaugcggucggacgcccccaucgggaagugcaacuccgagugcaucacccccaacggcucgauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagagcacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggucguacaacgccgagcugcugguggcccucgagaaccagcacaccaucgaccugacggacuccgagaugaacaagcuggucgagaagaccaagaagcagcuccgcgagaacgcggaggacauggggaacggcugcuucaagaucuaccacaagugcgacaacgccugcaucgggucgauccgcaacggcaccuacgaccacgacguguaccgggacgaggcccugaacaaccgcuuccagaucaaggggguggagcugaaguccggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 10962 - RNA, 1701 nt, Artificial Sequence; identical to SEQ ID NO: 10863
  derived and/or modified CDS sequence (AUadapt) from InfluenzaA__AHC59833__HA

SEQ ID NO: 10963 - RNA, 1701 nt, Artificial Sequence; identical to SEQ ID NO: 10862
  derived and/or modified CDS sequence (AUadapt) from InfluenzaA__AHC59845__HA

SEQ ID NO: 10964 - RNA, 1701 nt, Artificial Sequence; identical to SEQ ID NO: 8027
  derived and/or modified CDS sequence (AUadapt) from InfluenzaA__AHC59857__HA

SEQ ID NO: 10965 - RNA, 1701 nt, Artificial Sequence; identical to SEQ ID NO: 7227
  derived and/or modified CDS sequence (AUadapt) from InfluenzaA__AHC59869__HA

SEQ ID NO: 10966 - RNA, 1701 nt, Artificial Sequence; identical to SEQ ID NO: 7227
  derived and/or modified CDS sequence (AUadapt) from InfluenzaA__AHC59881__HA

SEQ ID NO: 10967 - RNA, 1701 nt, Artificial Sequence; identical to SEQ ID NO: 7100
  derived and/or modified CDS sequence (AUadapt) from InfluenzaA__AHC59892__HA

SEQ ID NO: 10968 - RNA, 1701 nt, Artificial Sequence
  derived and/or modified CDS sequence (AUadapt) from InfluenzaA__AHC59904__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggaugauggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 10969 - RNA, 1701 nt, Artificial Sequence
  derived and/or modified CDS sequence (AUadapt) from InfluenzaA__AHC59915__HA
augaagaccgugaucgcccugucguacauccucugccuggccuucgcgcagaagcugcccggcaacgacaacuccaccgccacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggcguacuccaacugcuaccccuacgacgugccggacuacgccagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcgcugaacgugaccaugcccaacaacgagcaguucgacaagcucuacaucuggggcguccaccaccccgggaccgacaaggaccagaucuuccuguacgcccaggccagcgggcggaucaccguguccacgaagcgcucgcagcaggccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcgcccaucggcaagugcaacucggagugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 10970 - RNA, 1701 nt, Artificial Sequence; identical to SEQ ID NO: 7227
  derived and/or modified CDS sequence (AUadapt) from InfluenzaA__AHC59939__HA

SEQ ID NO: 10971 - RNA, 1701 nt, Artificial Sequence
  derived and/or modified CDS sequence (AUadapt) from InfluenzaA__AHC59963__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacaucaagcagucgacccugaagcucgcgaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 10972 - RNA, 1701 nt, Artificial Sequence; identical to SEQ ID NO: 7100
  derived and/or modified CDS sequence (AUadapt) from InfluenzaA__AHC59987__HA

SEQ ID NO: 10973 - RNA, 1701 nt, Artificial Sequence; identical to SEQ ID NO: 7100
  derived and/or modified CDS sequence (AUadapt) from InfluenzaA__AHC59999__HA

SEQ ID NO: 10974 - RNA, 1701 nt, Artificial Sequence; identical to SEQ ID NO: 7227
  derived and/or modified CDS sequence (AUadapt) from InfluenzaA__AHC60011__HA

SEQ ID NO: 10975 - RNA, 1701 nt, Artificial Sequence; identical to SEQ ID NO: 7100
  derived and/or modified CDS sequence (AUadapt) from InfluenzaA__AHC60023__HA

SEQ ID NO: 10976 - RNA, 1701 nt, Artificial Sequence; identical to SEQ ID NO: 8027
  derived and/or modified CDS sequence (AUadapt) from InfluenzaA__AHC60035__HA

SEQ ID NO: 10977 - RNA, 1701 nt, Artificial Sequence; identical to SEQ ID NO: 8027
  derived and/or modified CDS sequence (AUadapt) from InfluenzaA__AHC60047__HA

SEQ ID NO: 10978 - RNA, 1701 nt, Artificial Sequence
  derived and/or modified CDS sequence (AUadapt) from InfluenzaA__AHC60059__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgcgugcaucacccccaacggcucgauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacaaccacgacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 10979 - RNA, 1701 nt, Artificial Sequence; identical to SEQ ID NO: 9319
  derived and/or modified CDS sequence (AUadapt) from InfluenzaA__AHC60071__HA

SEQ ID NO: 10980 - RNA, 1701 nt, Artificial Sequence; identical to SEQ ID NO: 10863
  derived and/or modified CDS sequence (AUadapt) from InfluenzaA__AHC60083__HA

SEQ ID NO: 10981 - RNA, 1701 nt, Artificial Sequence; identical to SEQ ID NO: 8027
  derived and/or modified CDS sequence (AUadapt) from InfluenzaA__AHC60095__HA

SEQ ID NO: 10982 - RNA, 1701 nt, Artificial Sequence
  derived and/or modified CDS sequence (AUadapt) from InfluenzaA__AHC60107__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacgucuaccgggacgaggcccugaacaaccgcuucaagaucaaggggguggagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 10983 - RNA, 1701 nt, Artificial Sequence; identical to SEQ ID NO: 7227
  derived and/or modified CDS sequence (AUadapt) from InfluenzaA__AHC60119__HA

SEQ ID NO: 10984 - RNA, 1701 nt, Artificial Sequence; identical to SEQ ID NO: 7227
  derived and/or modified CDS sequence (AUadapt) from InfluenzaA__AHC60131__HA

SEQ ID NO: 10985 - RNA, 1701 nt, Artificial Sequence; identical to SEQ ID NO: 10893
  derived and/or modified CDS sequence (AUadapt) from InfluenzaA__AHC60143__HA

SEQ ID NO: 10986 - RNA, 1701 nt, Artificial Sequence
  derived and/or modified CDS sequence (AUadapt) from InfluenzaA__AHC60155__HA
augaagaccgugaucgcccugucguacauccucugccuggccuucgcgcagaagcugcccggcaacgacaacuccaccgccacgcucugccuggggcaccacgccgucccgaacggcaccaucgugaagaccaucaccaacgaccagaucgaggugacgaacgccaccgagcugguccagucgucccccaccggggagaucugcgacagcccccaccagauccucgacggcgagaacugcacccugaucgacgcccugcucggggacccccagugcgacggcuuccagaacaagaagugggaccuguucguggagcgcuccaaggcguacucgaacugcuacccguacgacgugcccgacuacgccucccugcggucgcucgucgccuccagcggcacgcuggaguucaacaacgaguccuucaacuggaccggggugacccagaacggcaccucguccgccugcauccgccggucgaacaacuccuucuucagccgccugaacuggcucacgcaccugaacuucaaguaccccgcgcugaacgugaccaugcccaacaacgagcaguucgacaagcucuacaucuggggcguccaccacccggggaccgacaaggaccagaucuuccuguacgcccaggccuccgggcggaucaccgugucgacgaagcgcucccagcaggccgugauccccaacaucggcucgcggccccgcguccggaacauccccagccgcaucuccaucuacuggaccaucgugaagccgggcgacauccugcucaucaacucgaccgggaaccugaucgcgccccggggcuacuucaagauccgcuccggcaagucguccaucaugcggagcgacgcccccaucgggaagugcaacuccgagugcaucacccccaacggcucgaucccgaacgacaagcccuuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcgcugcucggcuucaucaugugggccugccagaaggggaacauccggugcaacaucugcaucuga

SEQ ID NO: 10987 - RNA, 1701 nt, Artificial Sequence; identical to SEQ ID NO: 7100
  derived and/or modified CDS sequence (AUadapt) from InfluenzaA__AHC60167__HA

SEQ ID NO: 10988 - RNA, 1701 nt, Artificial Sequence; identical to SEQ ID NO: 8027
  derived and/or modified CDS sequence (AUadapt) from InfluenzaA__AHC60179__HA

SEQ ID NO: 10989 - RNA, 1701 nt, Artificial Sequence; identical to SEQ ID NO: 10938
  derived and/or modified CDS sequence (AUadapt) from InfluenzaA__AHC60191__HA

SEQ ID NO: 10990 - RNA, 1701 nt, Artificial Sequence; identical to SEQ ID NO: 10938
  derived and/or modified CDS sequence (AUadapt) from InfluenzaA__AHC60203__HA

SEQ ID NO: 10991 - RNA, 1701 nt, Artificial Sequence; identical to SEQ ID NO: 9319
  derived and/or modified CDS sequence (AUadapt) from InfluenzaA__AHC60215__HA

SEQ ID NO: 10992 - RNA, 1701 nt, Artificial Sequence; identical to SEQ ID NO: 8027
  derived and/or modified CDS sequence (AUadapt) from InfluenzaA__AHC60239__HA

SEQ ID NO: 10993 - RNA, 1701 nt, Artificial Sequence; identical to SEQ ID NO: 8027
  derived and/or modified CDS sequence (AUadapt) from InfluenzaA__AHC60251__HA

SEQ ID NO: 10994 - RNA, 1701 nt, Artificial Sequence
  derived and/or modified CDS sequence (AUadapt) from InfluenzaA__AHC60263__HA
augaagaccaucaucgcccugucguacauccucugccugguguucgcccagaagcugcccggcaacgagaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 10995 - RNA, 1701 nt, Artificial Sequence; identical to SEQ ID NO: 7100
  derived and/or modified CDS sequence (AUadapt) from InfluenzaA__AHC60275__HA

SEQ ID NO: 10996 - RNA, 1701 nt, Artificial Sequence; identical to SEQ ID NO: 10982
  derived and/or modified CDS sequence (AUadapt) from InfluenzaA__AHC60287__HA

SEQ ID NO: 10997 - RNA, 1701 nt, Artificial Sequence; identical to SEQ ID NO: 10863
  derived and/or modified CDS sequence (AUadapt) from InfluenzaA__AHC60299__HA

SEQ ID NO: 10998 - RNA, 1701 nt, Artificial Sequence
  derived and/or modified CDS sequence (AUadapt) from InfluenzaA__AHC60311__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucgacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 10999 - RNA, 1701 nt, Artificial Sequence; identical to SEQ ID NO: 8027
  derived and/or modified CDS sequence (AUadapt) from InfluenzaA__AHC60323__HA

SEQ ID NO: 11000 - RNA, 1701 nt, Artificial Sequence; identical to SEQ ID NO: 9319
  derived and/or modified CDS sequence (AUadapt) from InfluenzaA__AHC60335__HA

SEQ ID NO: 11001 - RNA, 1701 nt, Artificial Sequence; identical to SEQ ID NO: 7100
  derived and/or modified CDS sequence (AUadapt) from InfluenzaA__AHC60347__HA

SEQ ID NO: 11002 - RNA, 1701 nt, Artificial Sequence; identical to SEQ ID NO: 7227
  derived and/or modified CDS sequence (AUadapt) from InfluenzaA__AHC60359__HA

SEQ ID NO: 11003 - RNA, 1701 nt, Artificial Sequence; identical to SEQ ID NO: 10924
  derived and/or modified CDS sequence (AUadapt) from InfluenzaA__AHC60371__HA

SEQ ID NO: 11004 - RNA, 1701 nt, Artificial Sequence; identical to SEQ ID NO: 7100
  derived and/or modified CDS sequence (AUadapt) from InfluenzaA__AHC60383__HA

SEQ ID NO: 11005 - RNA, 1701 nt, Artificial Sequence; identical to SEQ ID NO: 7227
  derived and/or modified CDS sequence (AUadapt) from InfluenzaA__AHC60395__HA

SEQ ID NO: 11006 - RNA, 1701 nt, Artificial Sequence; identical to SEQ ID NO: 10938
  derived and/or modified CDS sequence (AUadapt) from InfluenzaA__AHC60407__HA

SEQ ID NO: 11007 - RNA, 1701 nt, Artificial Sequence; identical to SEQ ID NO: 7100
  derived and/or modified CDS sequence (AUadapt) from InfluenzaA__AHC60419__HA

SEQ ID NO: 11008 - RNA, 1701 nt, Artificial Sequence; identical to SEQ ID NO: 7227
  derived and/or modified CDS sequence (AUadapt) from InfluenzaA__AHC60431__HA

SEQ ID NO: 11009 - RNA, 1701 nt, Artificial Sequence; identical to SEQ ID NO: 7100
  derived and/or modified CDS sequence (AUadapt) from InfluenzaA__AHC60455__HA

SEQ ID NO: 11010 - RNA, 1701 nt, Artificial Sequence; identical to SEQ ID NO: 7100
  derived and/or modified CDS sequence (AUadapt) from InfluenzaA__AHC60467__HA

SEQ ID NO: 11011 - RNA, 1701 nt, Artificial Sequence; identical to SEQ ID NO: 10862
  derived and/or modified CDS sequence (AUadapt) from InfluenzaA__AHC60479__HA

SEQ ID NO: 11012 - RNA, 1701 nt, Artificial Sequence; identical to SEQ ID NO: 8027
  derived and/or modified CDS sequence (AUadapt) from InfluenzaA__AHC60491__HA

SEQ ID NO: 11013 - RNA, 1701 nt, Artificial Sequence
  derived and/or modified CDS sequence (AUadapt) from InfluenzaA__AHC60503__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgcgugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggcgugccagaaggggaacauccggugcaacaucugcaucuga

SEQ ID NO: 11014 - RNA, 1701 nt, Artificial Sequence; identical to SEQ ID NO: 7227
  derived and/or modified CDS sequence (AUadapt) from InfluenzaA__AHC60515__HA

SEQ ID NO: 11015 - RNA, 1701 nt, Artificial Sequence; identical to SEQ ID NO: 8027
  derived and/or modified CDS sequence (AUadapt) from InfluenzaA__AHC60527__HA

SEQ ID NO: 11016 - RNA, 1701 nt, Artificial Sequence; identical to SEQ ID NO: 7227
  derived and/or modified CDS sequence (AUadapt) from InfluenzaA__AHC60539__HA

SEQ ID NO: 11017 - RNA, 1701 nt, Artificial Sequence; identical to SEQ ID NO: 10874
  derived and/or modified CDS sequence (AUadapt) from InfluenzaA__AHC60551__HA

SEQ ID NO: 11018 - RNA, 1701 nt, Artificial Sequence; identical to SEQ ID NO: 9319
  derived and/or modified CDS sequence (AUadapt) from InfluenzaA__AHC60563__HA

SEQ ID NO: 11019 - RNA, 1701 nt, Artificial Sequence; identical to SEQ ID NO: 9319
  derived and/or modified CDS sequence (AUadapt) from InfluenzaA__AHC60575__HA

SEQ ID NO: 11020 - RNA, 1701 nt, Artificial Sequence
  derived and/or modified CDS sequence (AUadapt) from InfluenzaA__AHC60587__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccagaaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 11021 - RNA, 1701 nt, Artificial Sequence; identical to SEQ ID NO: 9319
  derived and/or modified CDS sequence (AUadapt) from InfluenzaA__AHC60599__HA

SEQ ID NO: 11022 - RNA, 1701 nt, Artificial Sequence; identical to SEQ ID NO: 7100
  derived and/or modified CDS sequence (AUadapt) from InfluenzaA__AHC60611__HA

SEQ ID NO: 11023 - RNA, 1701 nt, Artificial Sequence
  derived and/or modified CDS sequence (AUadapt) from InfluenzaA__AHC60623__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacccccaacggcucgauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11024 - RNA, 1701 nt, Artificial Sequence; identical to SEQ ID NO: 9319
  derived and/or modified CDS sequence (AUadapt) from InfluenzaA__AHC60635__HA

SEQ ID NO: 11025 - RNA, 1701 nt, Artificial Sequence
  derived and/or modified CDS sequence (AUadapt) from InfluenzaA__AHC60647__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagaacucguccaccggggagaucugcgacagcccccaccagauccucgacggcgagaacugcacgcugaucgacgcccugcucggggacccccagugcgacggcuuccagaacaagaagugggaccuguucguggagcgcuccaaggccuacucgaacugcuaccccuacgacgugccggacuacgccucccugcggagccucgucgcguccucgggcacccuggaguucaacaacgaguccuucaacuggaccggggugacccagaacggcacgucguccgccugcauccgccggagcaacaacuccuucuucucgcgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcguccgggcggaucacggugagcaccaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 11026 - RNA, 1701 nt, Artificial Sequence
  derived and/or modified CDS sequence (AUadapt) from InfluenzaA__AHC60659__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcaacucgccccaccagauccucgacggcgagaacugcacgcugaucgacgcccugcucggggacccccagugcgacggcuuccagaacaagaagugggaccuguucguggagcgcucgaaggcccacuccaacugcuaccccuacgacgugccggacuacgccagccugcggucccucgucgcgucguccggcacccuggaguucaacaacgagucguucaacuggaccggggugacccagaacggcacguccagcgccugcauccgccgguccaacaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcggccgggcggaucacggugucgaccaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgcgugcaucacgcccaacggcucgauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagucgacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11027 - RNA, 1701 nt, Artificial Sequence
  derived and/or modified CDS sequence (AUadapt) from InfluenzaA__AHC60671__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaaggagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11028 - RNA, 1701 nt, Artificial Sequence
  derived and/or modified CDS sequence (AUadapt) from InfluenzaA__AHC60683__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucauccggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 11029 - RNA, 1701 nt, Artificial Sequence
  derived and/or modified CDS sequence (AUadapt) from InfluenzaA__AHC60695__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcaugcgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 11030 - RNA, 1701 nt, Artificial Sequence
  derived and/or modified CDS sequence (AUadapt) from InfluenzaA__AHC60707__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccgacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggaucaucuggaucagcuucgccaucuccugcuuccugcucugcguggcccugcugggcuucaucaugugggcgugccagaaggggaacauccggugcaacaucugcaucuga

SEQ ID NO: 11031 - RNA, 1701 nt, Artificial Sequence; identical to SEQ ID NO: 7100
  derived and/or modified CDS sequence (AUadapt) from InfluenzaA__AHC60719__HA

SEQ ID NO: 11032 - RNA, 1701 nt, Artificial Sequence; identical to SEQ ID NO: 7227
  derived and/or modified CDS sequence (AUadapt) from InfluenzaA__AHC60731__HA

SEQ ID NO: 11033 - RNA, 1701 nt, Artificial Sequence; identical to SEQ ID NO: 10938
  derived and/or modified CDS sequence (AUadapt) from InfluenzaA__AHC60743__HA

SEQ ID NO: 11034 - RNA, 1701 nt, Artificial Sequence; identical to SEQ ID NO: 3656
  derived and/or modified CDS sequence (AUadapt) from InfluenzaA__AHC60767__HA

SEQ ID NO: 11035 - RNA, 1701 nt, Artificial Sequence
  derived and/or modified CDS sequence (AUadapt) from InfluenzaA__AHC60779__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccagcuccggcacgcuggaguucaacaacgagcgcuucaacuggaccggggugacccagaacggcaccucguccgccugcauccggcgcucgaacaacuccuucuucagccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcgcaucaccguguccacgaagcggucgcagcaggccgugaucccgaacaucggcucccgcccccggguccgcaacauccccucgcgggugucgaucuacuggaccaucgugaagcccggcgacauccugcucaucaacuccaccgggaaccugaucgccccgcgcggcuacuucaagauccggagcgggaaguccucgaucaugcgcuccgacgcgcccaucggcaagugcaacucggccugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacagcgaggggcgcggccaggccgccgaccugaaguccacgcaggccgccaucgaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgcggagcuccuggucgcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgcgaucagcugcuuccuccugugcgucgcccugcucggcuucaucaugugggccugccagaaggggaacauccgcugcaacaucugcaucuga

SEQ ID NO: 11036 - RNA, 1701 nt, Artificial Sequence; identical to SEQ ID NO: 7227
  derived and/or modified CDS sequence (AUadapt) from InfluenzaA__AHC60791__HA

SEQ ID NO: 11037 - RNA, 1701 nt, Artificial Sequence; identical to SEQ ID NO: 10896
  derived and/or modified CDS sequence (AUadapt) from InfluenzaA__AHC60803__HA

SEQ ID NO: 11038 - RNA, 1701 nt, Artificial Sequence; identical to SEQ ID NO: 7100
  derived and/or modified CDS sequence (AUadapt) from InfluenzaA__AHC60815__HA

SEQ ID NO: 11039 - RNA, 1701 nt, Artificial Sequence
  derived and/or modified CDS sequence (AUadapt) from InfluenzaA__AHC60827__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgacgagaucugcaacucgccccaccagauccucgacggggagaacugcacccugaucgacgcccugcucggcgacccccagugcgacggguuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggcgugacccagaacgggaccuccucggccugcauccgcggcuccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 11040 - RNA, 1701 nt, Artificial Sequence; identical to SEQ ID NO: 10874
  derived and/or modified CDS sequence (AUadapt) from InfluenzaA__AHC60839__HA

SEQ ID NO: 11041 - RNA, 1701 nt, Artificial Sequence; identical to SEQ ID NO: 7227
  derived and/or modified CDS sequence (AUadapt) from InfluenzaA__AHC60851__HA

SEQ ID NO: 11042 - RNA, 1701 nt, Artificial Sequence
  derived and/or modified CDS sequence (AUadapt) from InfluenzaA__AHC60863__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcucgcggccccgcguccggaacauccccucgcgcguguccaucuacuggaccaucgugaagcccggcgacauccugcucaucaacagcaccgggaaccugaucgccccgcggggcuacuucaagauccgcuccgggaaguccuccaucaugcggucggacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggucguacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaggcgggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 11043 - RNA, 1701 nt, Artificial Sequence; identical to SEQ ID NO: 7227
  derived and/or modified CDS sequence (AUadapt) from InfluenzaA__AHC60875__HA

SEQ ID NO: 11044 - RNA, 1701 nt, Artificial Sequence; identical to SEQ ID NO: 7227
  derived and/or modified CDS sequence (AUadapt) from InfluenzaA__AHC60887__HA

SEQ ID NO: 11045 - RNA, 1701 nt, Artificial Sequence; identical to SEQ ID NO: 3656
  derived and/or modified CDS sequence (AUadapt) from InfluenzaA__AHC60899__HA

SEQ ID NO: 11046 - RNA, 1701 nt, Artificial Sequence; identical to SEQ ID NO: 8027
  derived and/or modified CDS sequence (AUadapt) from InfluenzaA__AHC60911__HA

SEQ ID NO: 11047 - RNA, 1701 nt, Artificial Sequence; identical to SEQ ID NO: 10863
  derived and/or modified CDS sequence (AUadapt) from InfluenzaA__AHC60923__HA

SEQ ID NO: 11048 - RNA, 1701 nt, Artificial Sequence; identical to SEQ ID NO: 8027
  derived and/or modified CDS sequence (AUadapt) from InfluenzaA__AHC60935__HA

SEQ ID NO: 11049 - RNA, 1701 nt, Artificial Sequence; identical to SEQ ID NO: 7227
  derived and/or modified CDS sequence (AUadapt) from InfluenzaA__AHC60947__HA

SEQ ID NO: 11050 - RNA, 1701 nt, Artificial Sequence; identical to SEQ ID NO: 8027
  derived and/or modified CDS sequence (AUadapt) from InfluenzaA__AHC60959__HA

SEQ ID NO: 11051 - RNA, 1701 nt, Artificial Sequence; identical to SEQ ID NO: 7100
  derived and/or modified CDS sequence (AUadapt) from InfluenzaA__AHC60971__HA

SEQ ID NO: 11052 - RNA, 1701 nt, Artificial Sequence; identical to SEQ ID NO: 8027
  derived and/or modified CDS sequence (AUadapt) from InfluenzaA__AHC60983__HA

SEQ ID NO: 11053 - RNA, 1701 nt, Artificial Sequence; identical to SEQ ID NO: 7227
  derived and/or modified CDS sequence (AUadapt) from InfluenzaA__AHC61007__HA

SEQ ID NO: 11054 - RNA, 1701 nt, Artificial Sequence; identical to SEQ ID NO: 7100
  derived and/or modified CDS sequence (AUadapt) from InfluenzaA__AHC61019__HA

SEQ ID NO: 11055 - RNA, 1701 nt, Artificial Sequence
  derived and/or modified CDS sequence (AUadapt) from InfluenzaA__AHC61031__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcucgcggccccgcguccggaacauccccagccgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgugcugcucggcuucaucaugugggccugccagaaggggaacauccggugcaacaucugcaucuga

SEQ ID NO: 11056 - RNA, 1701 nt, Artificial Sequence; identical to SEQ ID NO: 8027
  derived and/or modified CDS sequence (AUadapt) from InfluenzaA__AHC61043__HA

SEQ ID NO: 11057 - RNA, 1701 nt, Artificial Sequence
  derived and/or modified CDS sequence (AUadapt) from InfluenzaA__AHC61055__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccagaaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 11058 - RNA, 1701 nt, Artificial Sequence; identical to SEQ ID NO: 10924
  derived and/or modified CDS sequence (AUadapt) from InfluenzaA__AHC61067__HA

SEQ ID NO: 11059 - RNA, 1701 nt, Artificial Sequence; identical to SEQ ID NO: 9319
  derived and/or modified CDS sequence (AUadapt) from InfluenzaA__AHC61079__HA

SEQ ID NO: 11060 - RNA, 1701 nt, Artificial Sequence; identical to SEQ ID NO: 7227
  derived and/or modified CDS sequence (AUadapt) from InfluenzaA__AHC61103__HA

SEQ ID NO: 11061 - RNA, 1701 nt, Artificial Sequence; identical to SEQ ID NO: 7227
  derived and/or modified CDS sequence (AUadapt) from InfluenzaA__AHC61115__HA

SEQ ID NO: 11062 - RNA, 1701 nt, Artificial Sequence; identical to SEQ ID NO: 8027
  derived and/or modified CDS sequence (AUadapt) from InfluenzaA__AHC61127__HA

SEQ ID NO: 11063 - RNA, 1701 nt, Artificial Sequence
  derived and/or modified CDS sequence (AUadapt) from InfluenzaA__AHC61139__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgcagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacaaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11064 - RNA, 1701 nt, Artificial Sequence; identical to SEQ ID NO: 7227
  derived and/or modified CDS sequence (AUadapt) from InfluenzaA__AHC61151__HA

SEQ ID NO: 11065 - RNA, 1701 nt, Artificial Sequence
  derived and/or modified CDS sequence (AUadapt) from InfluenzaA__AHC61163__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaagaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccguggucccgaacaucggcucgcggccccgcgugcggaacauccccucccgcgugagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 11066 - RNA, 1701 nt, Artificial Sequence; identical to SEQ ID NO: 8027
  derived and/or modified CDS sequence (AUadapt) from InfluenzaA__AHC61175__HA

SEQ ID NO: 11067 - RNA, 1701 nt, Artificial Sequence; identical to SEQ ID NO: 7227
  derived and/or modified CDS sequence (AUadapt) from InfluenzaA__AHC61187__HA

SEQ ID NO: 11068 - RNA, 1701 nt, Artificial Sequence; identical to SEQ ID NO: 7100
  derived and/or modified CDS sequence (AUadapt) from InfluenzaA__AHC61199__HA

SEQ ID NO: 11069 - RNA, 1701 nt, Artificial Sequence; identical to SEQ ID NO: 10863
  derived and/or modified CDS sequence (AUadapt) from InfluenzaA__AHC61211__HA

SEQ ID NO: 11070 - RNA, 1701 nt, Artificial Sequence; identical to SEQ ID NO: 7100
  derived and/or modified CDS sequence (AUadapt) from InfluenzaA__AHC61223__HA

SEQ ID NO: 11071 - RNA, 1701 nt, Artificial Sequence; identical to SEQ ID NO: 7227
  derived and/or modified CDS sequence (AUadapt) from InfluenzaA__AHC61235__HA

SEQ ID NO: 11072 - RNA, 1701 nt, Artificial Sequence; identical to SEQ ID NO: 8027
  derived and/or modified CDS sequence (AUadapt) from InfluenzaA__AHC61247__HA

SEQ ID NO: 11073 - RNA, 1701 nt, Artificial Sequence; identical to SEQ ID NO: 8027
  derived and/or modified CDS sequence (AUadapt) from InfluenzaA__AHC61259__HA

SEQ ID NO: 11074 - RNA, 1701 nt, Artificial Sequence; identical to SEQ ID NO: 7227
  derived and/or modified CDS sequence (AUadapt) from InfluenzaA__AHC61271__HA

SEQ ID NO: 11075 - RNA, 1701 nt, Artificial Sequence; identical to SEQ ID NO: 7100
  derived and/or modified CDS sequence (AUadapt) from InfluenzaA__AHC61283__HA

SEQ ID NO: 11076 - RNA, 1701 nt, Artificial Sequence; identical to SEQ ID NO: 9319
  derived and/or modified CDS sequence (AUadapt) from InfluenzaA__AHC61295__HA

SEQ ID NO: 11077 - RNA, 1701 nt, Artificial Sequence; identical to SEQ ID NO: 10931
  derived and/or modified CDS sequence (AUadapt) from InfluenzaA__AHC61307__HA

SEQ ID NO: 11078 - RNA, 1701 nt, Artificial Sequence; identical to SEQ ID NO: 7227
  derived and/or modified CDS sequence (AUadapt) from InfluenzaA__AHC61319__HA

SEQ ID NO: 11079 - RNA, 1701 nt, Artificial Sequence; identical to SEQ ID NO: 10863
  derived and/or modified CDS sequence (AUadapt) from InfluenzaA__AHC61331__HA

SEQ ID NO: 11080 - RNA, 1701 nt, Artificial Sequence
  derived and/or modified CDS sequence (AUadapt) from InfluenzaA__AHC61343__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccggaucagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgugaaccggaucacguacggcgccugcccccgcuacgucaagcagaacacccugaagcucgccaccgggaugcggaacgugcccgagaagcagacccgcggcaucuucggggccaucgccggcuucaucgagaacggcugggaggggaugguggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 11081 - RNA, 1701 nt, Artificial Sequence; identical to SEQ ID NO: 7100
  derived and/or modified CDS sequence (AUadapt) from InfluenzaA__AHC61355__HA

SEQ ID NO: 11082 - RNA, 1701 nt, Artificial Sequence; identical to SEQ ID NO: 7100
  derived and/or modified CDS sequence (AUadapt) from InfluenzaA__AHC61367__HA

SEQ ID NO: 11083 - RNA, 1701 nt, Artificial Sequence; identical to SEQ ID NO: 7227
  derived and/or modified CDS sequence (AUadapt) from InfluenzaA__AHC61379__HA

SEQ ID NO: 11084 - RNA, 1701 nt, Artificial Sequence; identical to SEQ ID NO: 7100
  derived and/or modified CDS sequence (AUadapt) from InfluenzaA__AHC61391__HA

SEQ ID NO: 11085 - RNA, 1701 nt, Artificial Sequence
  derived and/or modified CDS sequence (AUadapt) from InfluenzaA__AHC61403__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcucgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11086 - RNA, 1701 nt, Artificial Sequence; identical to SEQ ID NO: 7227
  derived and/or modified CDS sequence (AUadapt) from InfluenzaA__AHC61415__HA

SEQ ID NO: 11087 - RNA, 1701 nt, Artificial Sequence
  derived and/or modified CDS sequence (AUadapt) from InfluenzaA__AHC61427__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaacaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucauccggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 11088 - RNA, 1701 nt, Artificial Sequence
  derived and/or modified CDS sequence (AUadapt) from InfluenzaA__AHC61439__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccacgugcaucacccccaacggcucgauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagucgacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11089 - RNA, 1701 nt, Artificial Sequence; identical to SEQ ID NO: 7100
  derived and/or modified CDS sequence (AUadapt) from InfluenzaA__AHC61451__HA

SEQ ID NO: 11090 - RNA, 1701 nt, Artificial Sequence; identical to SEQ ID NO: 7100
  derived and/or modified CDS sequence (AUadapt) from InfluenzaA__AHC61463__HA

SEQ ID NO: 11091 - RNA, 1701 nt, Artificial Sequence; identical to SEQ ID NO: 8027
  derived and/or modified CDS sequence (AUadapt) from InfluenzaA__AHC61475__HA

SEQ ID NO: 11092 - RNA, 1701 nt, Artificial Sequence; identical to SEQ ID NO: 7227
  derived and/or modified CDS sequence (AUadapt) from InfluenzaA__AHC61487__HA

SEQ ID NO: 11093 - RNA, 1701 nt, Artificial Sequence; identical to SEQ ID NO: 8027
  derived and/or modified CDS sequence (AUadapt) from InfluenzaA__AHC61499__HA

SEQ ID NO: 11094 - RNA, 1701 nt, Artificial Sequence; identical to SEQ ID NO: 7100
  derived and/or modified CDS sequence (AUadapt) from InfluenzaA__AHC61511__HA

SEQ ID NO: 11095 - RNA, 1701 nt, Artificial Sequence; identical to SEQ ID NO: 9319
  derived and/or modified CDS sequence (AUadapt) from InfluenzaA__AHC61523__HA

SEQ ID NO: 11096 - RNA, 1701 nt, Artificial Sequence
  derived and/or modified CDS sequence (AUadapt) from InfluenzaA__AHC61535__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaccaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11097 - RNA, 1701 nt, Artificial Sequence; identical to SEQ ID NO: 7100
  derived and/or modified CDS sequence (AUadapt) from InfluenzaA__AHC61547__HA

SEQ ID NO: 11098 - RNA, 1701 nt, Artificial Sequence
  derived and/or modified CDS sequence (AUadapt) from InfluenzaA__AHC61559__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagaucaucgacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggucgcuggucgccuccagcggcacgcucgaguucaacaacgaguccuucaacuggaccggggugacccagaacggcaccucguccgccugcauccgccggucgaacaacuccuucuucagccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugucgacgaagcgcucccagcaggccgugaucccgaacaucggcucgcggccccgcguccggaacauccccagccgcaucuccaucuacuggaccaucgugaagcccggcgacauccugcugaucaacucgaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugauccggaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcucgauccggaacgggaccuacgaccacgacgucuaccgcgacgaggcccugaacaaccgguuccagaucaagggcguggagcucaaguccgggcacaaggacuggauccuguggaucagcuucgccaucuccugcuuccugcucugcguggcccugcugggcuucaucaugugggcgugccagaagggcaacauccgcugcaacaucugcaucuga

SEQ ID NO: 11099 - RNA, 1701 nt, Artificial Sequence; identical to SEQ ID NO: 9319
  derived and/or modified CDS sequence (AUadapt) from InfluenzaA__AHC61571__HA

SEQ ID NO: 11100 - RNA, 1701 nt, Artificial Sequence; identical to SEQ ID NO: 7100
  derived and/or modified CDS sequence (AUadapt) from InfluenzaA__AHC61583__HA

SEQ ID NO: 11101 - RNA, 1701 nt, Artificial Sequence; identical to SEQ ID NO: 9319
  derived and/or modified CDS sequence (AUadapt) from InfluenzaA__AHC61595__HA

SEQ ID NO: 11102 - RNA, 1701 nt, Artificial Sequence
  derived and/or modified CDS sequence (AUadapt) from InfluenzaA__AHC61607__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagcacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 11103 - RNA, 1701 nt, Artificial Sequence; identical to SEQ ID NO: 9319
  derived and/or modified CDS sequence (AUadapt) from InfluenzaA__AHC61619__HA

SEQ ID NO: 11104 - RNA, 1701 nt, Artificial Sequence
  derived and/or modified CDS sequence (AUadapt) from InfluenzaA__AHC61631__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcaccaucaucgacgcccugcugggggacccccagugcgacggcuuccagaacaagaagugggaccucuucguggagcgcucgaaggcccacuccaacugcuaccccuacgacgugccggacuacgcgagccugcggucccuggucgccucguccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcugaucaacucgaccgggaaccucaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgcggagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccgcaacggcaccuacgaccacgacguguaccgggacgaggcccugaacaaccgcuuccagaucaaggggguggagcucaaguccggcuacaaggacuggauccuguggaucagcuucgcgaucuccugcuuccugcucugcgucgcccugcugggcuucaucaugugggccugccagaaggggaacauccggugcaacaucugcaucuga

SEQ ID NO: 11105 - RNA, 1701 nt, Artificial Sequence
  derived and/or modified CDS sequence (AUadapt) from InfluenzaA__AHC61643__HA
augaagaccaucaucgcccugucguacgugcucugccuggucuucgcccagaagcugcccggcaacgacaacuccaccgcgacgcucugccuggggcaccacgccgugccgaacggcaccaucgugaagaccaucaccaacgaccagaucgaggucacgaacgccaccgagcuggugcagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgucccggacuacgcgagccugcggucccucguggccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgucaccaugcccaacaacgagcaguucgacaagcucuacaucuggggcgugcaccaccccgggaccgacaaggaccagaucuuccuguacgcgcaggccgccgggcggaucaccgugucgacgaagcgcucccagcaggccgucaucccgaacaucggcagccggccccgcgugcggaacauccccucgcgcguguccaucuacuggaccaucgucaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgcgggguucaucgagaacggcugggagggcaugguggacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaagggggucgagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 11106 - RNA, 1701 nt, Artificial Sequence
  derived and/or modified CDS sequence (AUadapt) from InfluenzaA__AHC61655__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcaacucgccccaccagauccucgacggcgagaacugcacgcugaucgacgcccugcucggggacccccagugcgacggcuuccagaacaacaagugggaccuguucguggagcgcucgaaggcccacuccaacugcuaccccuacgacgugccggacuacgccagccugcggucccucgucgcgucguccggcacccuggaguucaacaacgagucguucaacuggaccggggugacccagaacggcacguccagcgccugcauccgccgguccaacaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcggccgggcggaucacggugucgaccaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucauccggagcgacgcccccaucggcaagugcaacuccgcgugcaucacgcccaacggcucgauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagucgacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11107 - RNA, 1701 nt, Artificial Sequence
  derived and/or modified CDS sequence (AUadapt) from InfluenzaA__AHC61667__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagucguccgggcggaucaccgugagcacgaagcgcucgcagcaggccgugaucccgaacaucggcucccggccccgcauccggaacauccccagccgcaucuccaucuacuggaccaucgucaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggccugcccccgguacgugaagcaguccacccugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacgcaggcggccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11108 - RNA, 1701 nt, Artificial Sequence; identical to SEQ ID NO: 10863
  derived and/or modified CDS sequence (AUadapt) from InfluenzaA__AHC61679__HA

SEQ ID NO: 11109 - RNA, 1701 nt, Artificial Sequence; identical to SEQ ID NO: 9319
  derived and/or modified CDS sequence (AUadapt) from InfluenzaA__AHC61691__HA

SEQ ID NO: 11110 - RNA, 1701 nt, Artificial Sequence; identical to SEQ ID NO: 7100
  derived and/or modified CDS sequence (AUadapt) from InfluenzaA__AHC61703__HA

SEQ ID NO: 11111 - RNA, 1701 nt, Artificial Sequence; identical to SEQ ID NO: 10896
  derived and/or modified CDS sequence (AUadapt) from InfluenzaA__AHC61715__HA

SEQ ID NO: 11112 - RNA, 1701 nt, Artificial Sequence; identical to SEQ ID NO: 8027
  derived and/or modified CDS sequence (AUadapt) from InfluenzaA__AHC61727__HA

SEQ ID NO: 11113 - RNA, 1701 nt, Artificial Sequence; identical to SEQ ID NO: 7100
  derived and/or modified CDS sequence (AUadapt) from InfluenzaA__AHC61739__HA

SEQ ID NO: 11114 - RNA, 1701 nt, Artificial Sequence
  derived and/or modified CDS sequence (AUadapt) from InfluenzaA__AHC61751__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacgucggcucgcggccccgcgugcggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgucaaccgcaucacguacggggcgugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggcgugccagaaggggaacauccggugcaacaucugcaucuga

SEQ ID NO: 11115 - RNA, 1701 nt, Artificial Sequence
  derived and/or modified CDS sequence (AUadapt) from InfluenzaA__AHC61763__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcagaccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgcgugcaucacgcccaacggcucgauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggcggggccaggcggccgaccucaagucgacccaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11116 - RNA, 1701 nt, Artificial Sequence; identical to SEQ ID NO: 7227
  derived and/or modified CDS sequence (AUadapt) from InfluenzaA__AHC61775__HA

SEQ ID NO: 11117 - RNA, 1701 nt, Artificial Sequence; identical to SEQ ID NO: 8027
  derived and/or modified CDS sequence (AUadapt) from InfluenzaA__AHC61787__HA

SEQ ID NO: 11118 - RNA, 1701 nt, Artificial Sequence; identical to SEQ ID NO: 10863
  derived and/or modified CDS sequence (AUadapt) from InfluenzaA__AHC61799__HA

SEQ ID NO: 11119 - RNA, 1701 nt, Artificial Sequence
  derived and/or modified CDS sequence (AUadapt) from InfluenzaA__AHC61823__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugaaguccgacgcccccaucgacaagugcaacagcgagugcaucacccccaacggcuccauccccaacgacaagccguuccagaacgugaaccggaucacguacggcgccugcccccgcuacgugaagcagucgacccugaagcucgcgaccgggaugcggaacguccccgagaagcagacccgcggcaucuucggggccaucgccggcuucaucgagaacgggugggagggcaugguggacggcugguacggguuccggcaccagaacuccgagggccgcgggcaggccgccgaccugaaguccacgcaggcggccaucgaccagaucaacggcaagcugaaccggcucaucgggaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacaugggcaacgggugcuucaagaucuaccacaagugcgacaacgcgugcaucggcucgauccgcaacgggaccuacaaccacgacguguaccgcgacgaggcccucaacaaccgguuccagaucaagggcgucgagcugaaguccggguacaaggacuggauccuguggaucagcuucgccaucagcugcuuccuccugugcguggcccugcucggcuucaucaugugggccugccagaagggcaacauccgcugcaacaucugcaucuga

SEQ ID NO: 11120 - RNA, 1701 nt, Artificial Sequence; identical to SEQ ID NO: 8027
  derived and/or modified CDS sequence (AUadapt) from InfluenzaA__AHC61835__HA

SEQ ID NO: 11121 - RNA, 1701 nt, Artificial Sequence; identical to SEQ ID NO: 7227
  derived and/or modified CDS sequence (AUadapt) from InfluenzaA__AHC61847__HA

SEQ ID NO: 11122 - RNA, 1701 nt, Artificial Sequence; identical to SEQ ID NO: 7100
  derived and/or modified CDS sequence (AUadapt) from InfluenzaA__AHC61859__HA

SEQ ID NO: 11123 - RNA, 1701 nt, Artificial Sequence; identical to SEQ ID NO: 8027
  derived and/or modified CDS sequence (AUadapt) from InfluenzaA__AHC61871__HA

SEQ ID NO: 11124 - RNA, 1701 nt, Artificial Sequence
  derived and/or modified CDS sequence (AUadapt) from InfluenzaA__AHC61883__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccagcgggcggaucaccgugucgacgaagcgcucccagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucgccgacuccgagaugaacaagcuguucgagaagacgaagaagcagcugcgcgagaacgcggaggacauggggaacggcugcuucaagaucuaccacaagugcgacaacgccugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 11125 - RNA, 1701 nt, Artificial Sequence; identical to SEQ ID NO: 7227
  derived and/or modified CDS sequence (AUadapt) from InfluenzaA__AHC61895__HA

SEQ ID NO: 11126 - RNA, 1701 nt, Artificial Sequence; identical to SEQ ID NO: 7227
  derived and/or modified CDS sequence (AUadapt) from InfluenzaA__AHC61907__HA

SEQ ID NO: 11127 - RNA, 1701 nt, Artificial Sequence
  derived and/or modified CDS sequence (AUadapt) from InfluenzaA__AHC61931__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaagggcuggauccuguggaucagcuucgcgaucuccugcuuccuccugugcgucgcccugcucggguucaucaugugggccugccagaagggcaacauccggugcaacaucugcaucuga

SEQ ID NO: 11128 - RNA, 1701 nt, Artificial Sequence; identical to SEQ ID NO: 8027
  derived and/or modified CDS sequence (AUadapt) from InfluenzaA__AHC61943__HA

SEQ ID NO: 11129 - RNA, 1701 nt, Artificial Sequence; identical to SEQ ID NO: 9319
  derived and/or modified CDS sequence (AUadapt) from InfluenzaA__AHC61955__HA

SEQ ID NO: 11130 - RNA, 1701 nt, Artificial Sequence; identical to SEQ ID NO: 8027
  derived and/or modified CDS sequence (AUadapt) from InfluenzaA__AHC61967__HA

SEQ ID NO: 11131 - RNA, 1701 nt, Artificial Sequence; identical to SEQ ID NO: 7100
  derived and/or modified CDS sequence (AUadapt) from InfluenzaA__AHC61979__HA

SEQ ID NO: 11132 - RNA, 1701 nt, Artificial Sequence; identical to SEQ ID NO: 7227
  derived and/or modified CDS sequence (AUadapt) from InfluenzaA__AHC61991__HA

SEQ ID NO: 11133 - RNA, 1701 nt, Artificial Sequence; identical to SEQ ID NO: 10938
  derived and/or modified CDS sequence (AUadapt) from InfluenzaA__AHC62003__HA

SEQ ID NO: 11134 - RNA, 1701 nt, Artificial Sequence; identical to SEQ ID NO: 8027
  derived and/or modified CDS sequence (AUadapt) from InfluenzaA__AHC62015__HA

SEQ ID NO: 11135 - RNA, 1701 nt, Artificial Sequence; identical to SEQ ID NO: 9319
  derived and/or modified CDS sequence (AUadapt) from InfluenzaA__AHC62027__HA

SEQ ID NO: 11136 - RNA, 1701 nt, Artificial Sequence
  derived and/or modified CDS sequence (AUadapt) from InfluenzaA__AHC62039__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugaaguccgacgcccccaucggcaagugcaacucggcgugcaucacccccaacggguccauccccaacgacaagccguuccagaacgucaaccgcaucacguacggcgccugcccccgguacgugaagcagaacacccugaagcucgccaccgggaugcgcaacgugcccgagaagcagacccggggcaucuucggggccaucgccggcuucaucgagaacggcugggaggggaugauggacggcugguacggguuccgccaccagaacucggagggccgggggcaggcggccgaccugaaguccacgcaggccgccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgcuuccagaucaagggcguggagcugaaguccggcuacaaggacuggauccuguggaucuccuucgccaucagcugcuuccuccugugcguggcgcugcucggguucaucaugugggccugccagaagggcaacauccggugcaacaucugcaucuga

SEQ ID NO: 11137 - RNA, 1701 nt, Artificial Sequence
  derived and/or modified CDS sequence (AUadapt) from InfluenzaA__AHC62050__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacgugcccucccgcgugagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 11138 - RNA, 1701 nt, Artificial Sequence; identical to SEQ ID NO: 9319
  derived and/or modified CDS sequence (AUadapt) from InfluenzaA__AHC62062__HA

SEQ ID NO: 11139 - RNA, 1701 nt, Artificial Sequence
  derived and/or modified CDS sequence (AUadapt) from InfluenzaA__AHC62074__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcaaccagcaggccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacaaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 11140 - RNA, 1701 nt, Artificial Sequence; identical to SEQ ID NO: 7100
  derived and/or modified CDS sequence (AUadapt) from InfluenzaA__AHC62086__HA

SEQ ID NO: 11141 - RNA, 1701 nt, Artificial Sequence; identical to SEQ ID NO: 8027
  derived and/or modified CDS sequence (AUadapt) from InfluenzaA__AHC62098__HA

SEQ ID NO: 11142 - RNA, 1701 nt, Artificial Sequence; identical to SEQ ID NO: 7100
  derived and/or modified CDS sequence (AUadapt) from InfluenzaA__AHC62110__HA

SEQ ID NO: 11143 - RNA, 1701 nt, Artificial Sequence
  derived and/or modified CDS sequence (AUadapt) from InfluenzaA__AHC62122__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagaugguccagucguccagcaccggggagaucugcaacucgccccaccagauccuggacggcgagaacugcacccucaucgacgcccugcugggggacccccagugcgacggcuuccagaacaagaagugggaccucuucguggagcgcucgaaggcccacuccaacugcuaccccuacgacgugccggacuacgcgagccugcggucccuggucgccucguccggcacgcucgaguucaacaacgagagcuucaacuggaccggggugacccagaacggcaccuccucggccugcauccgcggguccaacaacucguucuucucccggcugaacuggcugacgcacagcaacuucaaguaccccgcccucaacgugaccaugcccaacaacgagcaguucgacaagcuguacaucuggggcguccaccaccccgggaccgacaaggaccagaucuuccuguacgcgcaggccuccggccgcaucaccgugucgacgaagcggucgcagcaggccgugaucccgaacaucggcucccgcccccggguccgcaacauccccagccggguguccaucuacuggaccaucgugaagcccggggacauccuccugaucaacucgaccggcaaccugaucgccccgcgcggguacuucaagauccgguccggcaagagcuccaucaugcgcucggacgcccccaucggcaagugcaacuccgcgugcaucacccccaacgggucgauccccaacgacaagccguuccagaacgucaaccggaucacguacggcgccugcccccgcuacgugaagcagaacacccucaagcuggccaccgggaugcggaacgugcccgagaagcagacccgcggcaucuucggggccaucgccggcuucaucgagaacggcugggaggggauggucgacggcugguacggguuccggcaccagaacuccgagggccgcgggcaggcggccgaccugaaguccacgcaggccgccaucgaccagaucaacggcaagcucaaccggcugaucggcaagaccaacgagaaguuccaccagaucgagaaggaguucuccgagguggaggggcgcauccaggaccuggagaaguacguggaggacaccaagaucgaccucuggagcuacaacgccgagcugcuggucgcgcucgagaaccagcacaccaucgaccugacggacuccgagaugaacaagcuguucgagaagaccaagaagcagcuccgggagaacgccgaggacaugggcaacgggugcuucaagaucuaccacaagugcgacaacgccugcaucggcucgauccgcaacgggaccuacgaccacgacguguaccgcgacgaggcccugaacaaccgguuccgcaucaagggcguggagcugaaguccggcuacaaggacuggauccucuggaucagcuucgccaucuccugcuuccugcugugcgucgcgcuccugggguucaucaugugggccugccagaagggcaacauccggugcaacaucugcaucuga

SEQ ID NO: 11144 - RNA, 1701 nt, Artificial Sequence; identical to SEQ ID NO: 7100
  derived and/or modified CDS sequence (AUadapt) from InfluenzaA__AHC62134__HA

SEQ ID NO: 11145 - RNA, 1701 nt, Artificial Sequence
  derived and/or modified CDS sequence (AUadapt) from InfluenzaA__AHC62146__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcggaucaccgugagcacgaagcgcucccagcaggccgugaucccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucacguacggggccugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuacgaggggcggggccaggccgccgaccugaaguccacgcaggcggccaucgaccagaucaacgggaagcugaaccgccucaucggcaagaccaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11146 - RNA, 1701 nt, Artificial Sequence; identical to SEQ ID NO: 7227
  derived and/or modified CDS sequence (AUadapt) from InfluenzaA__AHC62158__HA

SEQ ID NO: 11147 - RNA, 1701 nt, Artificial Sequence
  derived and/or modified CDS sequence (AUadapt) from InfluenzaA__AHC62170__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggaugauggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacaacgucuaccgcgacgaggcccucaacaaccgguuccagaucaagggcguggagcugaaguccggcuacaaggacuggauccuguggaucuccuucgccaucagcugcuuccuccugugcguggcgcugcucggguucaucaugugggccugccagaagggcaacauccgcugcaacaucugcaucuga

SEQ ID NO: 11148 - RNA, 1701 nt, Artificial Sequence; identical to SEQ ID NO: 7100
  derived and/or modified CDS sequence (AUadapt) from InfluenzaA__AHC62182__HA

SEQ ID NO: 11149 - RNA, 1701 nt, Artificial Sequence; identical to SEQ ID NO: 9319
  derived and/or modified CDS sequence (AUadapt) from InfluenzaA__AHC62194__HA

SEQ ID NO: 11150 - RNA, 1701 nt, Artificial Sequence
  derived and/or modified CDS sequence (AUadapt) from InfluenzaA__AHC62206__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaucuggaccggggugacccagaacggcaccuccagcgccugcauccgccgguccaacucguccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcggaucaccgugagcacgaagcgcucccagcaggccgugaucccgaacaucggcucgcggccccgcauccggaacauccccucccgcaucagcaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgugaagcagucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacgcaggcggccaucgaccagaucaacgggaagcugaaccgccucaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 11151 - RNA, 1701 nt, Artificial Sequence; identical to SEQ ID NO: 7227
  derived and/or modified CDS sequence (AUadapt) from InfluenzaA__AHC62218__HA

SEQ ID NO: 11152 - RNA, 1701 nt, Artificial Sequence
  derived and/or modified CDS sequence (AUadapt) from InfluenzaA__AHC62242__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagaacucguccaccggggagaucugcgacagcccccaccagauccuggacggcgagaacugcacccucaucgacgcccugcugggggacccccagugcgacggcuuccagaacaagaagugggaccucuucguggagcgcuccaaggccuacucgaacugcuaccccuacgacgugccggacuacgcgucccugcggagccuggucgccuccucgggcacgcucgaguucaacaacgaguccuucaacuggaccggggugacccagaacggcaccucguccgccugcauccgccggagcaacaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcugaucaacagcaccgggaaccucaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucaucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccgcaacggcaccuacgaccacgacguguaccgggacgaggcccugaacaaccgcuuccagaucaagggggucgagcucaaguccggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 11153 - RNA, 1701 nt, Artificial Sequence; identical to SEQ ID NO: 10862
  derived and/or modified CDS sequence (AUadapt) from InfluenzaA__AHC62254__HA

SEQ ID NO: 11154 - RNA, 1701 nt, Artificial Sequence; identical to SEQ ID NO: 7227
  derived and/or modified CDS sequence (AUadapt) from InfluenzaA__AHC62266__HA

SEQ ID NO: 11155 - RNA, 1701 nt, Artificial Sequence; identical to SEQ ID NO: 11026
  derived and/or modified CDS sequence (AUadapt) from InfluenzaA__AHC62278__HA

SEQ ID NO: 11156 - RNA, 1701 nt, Artificial Sequence
  derived and/or modified CDS sequence (AUadapt) from InfluenzaA__AHC62290__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccggggagaucugcaacucgccccaccagauccucgacggcgagaacugcacccugaucgacgcccugcucggggacccccagugcgacggcuuccagaacaagaagugggaccuguucgucgagcgcucgaaggcccacuccaacugcuaccccuacgacgugccggacuacgcgagccugcggucccucguggccucguccggcacgcuggaguucaacaacgagagcuucaacuggaccggggucacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcgggcggaucaccgucuccacgaagcgcucgcagcaggccgugaucccgaacaucggcucgcggccccgcgugcggaacauccccucccgcgucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 11157 - RNA, 1701 nt, Artificial Sequence
  derived and/or modified CDS sequence (AUadapt) from InfluenzaA__AHC62302__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcucgcggccccgcguccggaacauccccucgcgcguguccaucuacuggaccaucgugaagcccggcgacauccugcucaucaacagcaccgggaaccugaucgccccgcggggcuacuucaagauccgcaacgggaaguccucgaucaugcgguccgacgcgcccaucggcaagugcaacucggccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacagcgaggggcggggccaggccgccgaccugaaguccacgcaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgcggagcuccuggucgcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgcgaucagcugcuuccuccugugcgucgcccugcucggcuucaucaugugggccugccagaaggggaacauccggugcaacaucugcaucuga

SEQ ID NO: 11158 - RNA, 1701 nt, Artificial Sequence
  derived and/or modified CDS sequence (AUadapt) from InfluenzaA__AHC62314__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagauccgcgggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 11159 - RNA, 1701 nt, Artificial Sequence; identical to SEQ ID NO: 11023
  derived and/or modified CDS sequence (AUadapt) from InfluenzaA__AHC62326__HA

SEQ ID NO: 11160 - RNA, 1701 nt, Artificial Sequence; identical to SEQ ID NO: 8027
  derived and/or modified CDS sequence (AUadapt) from InfluenzaA__AHC62338__HA

SEQ ID NO: 11161 - RNA, 1701 nt, Artificial Sequence; identical to SEQ ID NO: 7100
  derived and/or modified CDS sequence (AUadapt) from InfluenzaA__AHC62350__HA

SEQ ID NO: 11162 - RNA, 1701 nt, Artificial Sequence; identical to SEQ ID NO: 8027
  derived and/or modified CDS sequence (AUadapt) from InfluenzaA__AHC62362__HA

SEQ ID NO: 11163 - RNA, 1701 nt, Artificial Sequence; identical to SEQ ID NO: 8027
  derived and/or modified CDS sequence (AUadapt) from InfluenzaA__AHC62374__HA

SEQ ID NO: 11164 - RNA, 1701 nt, Artificial Sequence; identical to SEQ ID NO: 11026
  derived and/or modified CDS sequence (AUadapt) from InfluenzaA__AHC62386__HA

SEQ ID NO: 11165 - RNA, 1701 nt, Artificial Sequence; identical to SEQ ID NO: 7100
  derived and/or modified CDS sequence (AUadapt) from InfluenzaA__AHC62398__HA

SEQ ID NO: 11166 - RNA, 1701 nt, Artificial Sequence
  derived and/or modified CDS sequence (AUadapt) from InfluenzaA__AHC62410__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucauccgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11167 - RNA, 1701 nt, Artificial Sequence; identical to SEQ ID NO: 10969
  derived and/or modified CDS sequence (AUadapt) from InfluenzaA__AHC62422__HA

SEQ ID NO: 11168 - RNA, 1701 nt, Artificial Sequence
  derived and/or modified CDS sequence (AUadapt) from InfluenzaA__AHC62434__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccaguccgggaaguccuccaucaugcgcagcgacgcgcccaucggcaagugcaacuccgccugcaucacccccaacggcucgauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgcgggguucaucgagaacggcugggagggcauggucgacgggugguacggcuuccggcaccagaacuccgaggggcgcggccaggccgccgaccucaagucgacgcaggccgccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgccugcaucgggucgauccgcaacggcaccuacgaccacgacguguaccgcgacgaggcccucaacaaccgguuccagaucaaggggguggagcugaaguccggcuacaaggacuggauccuguggaucagcuucgcgaucuccugcuuccuccugugcgucgcccugcucggcuucaucaugugggccugccagaaggggaacauccgcugcaacaucugcaucuga

SEQ ID NO: 11169 - RNA, 1701 nt, Artificial Sequence; identical to SEQ ID NO: 7100
  derived and/or modified CDS sequence (AUadapt) from InfluenzaA__AHC62446__HA

SEQ ID NO: 11170 - RNA, 1701 nt, Artificial Sequence; identical to SEQ ID NO: 7227
  derived and/or modified CDS sequence (AUadapt) from InfluenzaA__AHC62458__HA

SEQ ID NO: 11171 - RNA, 1701 nt, Artificial Sequence
  derived and/or modified CDS sequence (AUadapt) from InfluenzaA__AHC62470__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgggaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggccgggggcaggccgcggaccucaagucgacgcaggccgccaucgaccagaucaacggcaagcugaaccgccugaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacaugggcaacgggugcuucaagaucuaccacaagugcgacaacgccugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 11172 - RNA, 1701 nt, Artificial Sequence; identical to SEQ ID NO: 10924
  derived and/or modified CDS sequence (AUadapt) from InfluenzaA__AHC62482__HA

SEQ ID NO: 11173 - RNA, 1701 nt, Artificial Sequence; identical to SEQ ID NO: 7100
  derived and/or modified CDS sequence (AUadapt) from InfluenzaA__AHC62506__HA

SEQ ID NO: 11174 - RNA, 1701 nt, Artificial Sequence; identical to SEQ ID NO: 7227
  derived and/or modified CDS sequence (AUadapt) from InfluenzaA__AHC62518__HA

SEQ ID NO: 11175 - RNA, 1701 nt, Artificial Sequence
  derived and/or modified CDS sequence (AUadapt) from InfluenzaA__AHC62530__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcuccaaggcccacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcagccagcaggccgugaucccgaacaucggcucgcggccccgcguccggaacauccccucccgcgugucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccucaaguccacgcaggccgccaucgaccagaucaacgggaagcugaaccgccugaucggcaagaccaacgagaaguuccaccagaucgagaaggaguucucggagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagucgggcuacaaggacuggauccuguggaucuccuucgccaucagcugcuuccugcucugcgucgcgcugcugggcuucaucaugugggccugccagaaggggaacauccggugcaacaucugcaucuga

SEQ ID NO: 11176 - RNA, 1701 nt, Artificial Sequence; identical to SEQ ID NO: 10896
  derived and/or modified CDS sequence (AUadapt) from InfluenzaA__AHC62542__HA

SEQ ID NO: 11177 - RNA, 1701 nt, Artificial Sequence; identical to SEQ ID NO: 7100
  derived and/or modified CDS sequence (AUadapt) from InfluenzaA__AHC62554__HA

SEQ ID NO: 11178 - RNA, 1701 nt, Artificial Sequence
  derived and/or modified CDS sequence (AUadapt) from InfluenzaA__AHC62566__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucccagcaggccgugaucccgaacaucggcucgcggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacccccaacggcucgauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 11179 - RNA, 1701 nt, Artificial Sequence; identical to SEQ ID NO: 7100
  derived and/or modified CDS sequence (AUadapt) from InfluenzaA__AHC62578__HA

SEQ ID NO: 11180 - RNA, 1701 nt, Artificial Sequence; identical to SEQ ID NO: 7100
  derived and/or modified CDS sequence (AUadapt) from InfluenzaA__AHC62590__HA

SEQ ID NO: 11181 - RNA, 1701 nt, Artificial Sequence; identical to SEQ ID NO: 7227
  derived and/or modified CDS sequence (AUadapt) from InfluenzaA__AHC62602__HA

SEQ ID NO: 11182 - RNA, 1701 nt, Artificial Sequence
  derived and/or modified CDS sequence (AUadapt) from InfluenzaA__AHC62614__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagaucaucgacggcgagaacugcacccucaucgacgcccugcugggggacccccagugcgacggcuuccagaacaagaagugggaccucuucguggagcgcuccaaggcccacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgcggguccaacaacucguucuucucccggcugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucgggccgcaucaccguguccacgaagcggagccagcaggccgugaucccgaacaucggcucgcgcccccggguccgcaacauccccucccgggugucgaucuacuggaccaucgugaagcccggggacauccugcugaucaacuccaccggcaaccucaucgccccgcgcggguacuucaagauccggagcggcaaguccucgaucaugcgcuccgacgcccccaucggcaagugcaacagcgcgugcaucacccccaacggguccauccccaacgacaagccguuccagaacgucaaccggaucacguacggcgccugcccccgcuacgugaagcagaacacccugaagcuggccaccgggaugcggaacgugcccgagaagcagacccgcggcaucuucggggccaucgccggcuucaucgagaacggcugggaggggauggucgacggcugguacggguuccggcaccagaacucggagggccgcgggcaggcggccgaccucaaguccacgcaggccgccaucgaccagaucaacggcaagcugaaccggcugaucggcaagaccaacgagaaguuccaccagaucgagaaggaguucucggagguggaggggcgcauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgggagaacgccgaggacaugggcaacgggugcuucaagaucuaccacaagugcgacaacgccugcaucggcuccauccgcaacgggaccuacgaccacgacguguaccgcgacgaggcccugaacaaccgguuccagaucaagggcguggagcucaagucgggcuacaaggacuggauccuguggaucuccuucgccaucagcugcuuccugcucugcgucgcgcugcugggguucaucaugugggccugccagaagggcaacauccgcugcaacaucugcaucuga

SEQ ID NO: 11183 - RNA, 1701 nt, Artificial Sequence; identical to SEQ ID NO: 10863
  derived and/or modified CDS sequence (AUadapt) from InfluenzaA__AHC62626__HA

SEQ ID NO: 11184 - RNA, 1701 nt, Artificial Sequence; identical to SEQ ID NO: 7227
  derived and/or modified CDS sequence (AUadapt) from InfluenzaA__AHC62638__HA

SEQ ID NO: 11185 - RNA, 1701 nt, Artificial Sequence; identical to SEQ ID NO: 11027
  derived and/or modified CDS sequence (AUadapt) from InfluenzaA__AHC62650__HA

SEQ ID NO: 11186 - RNA, 1701 nt, Artificial Sequence
  derived and/or modified CDS sequence (AUadapt) from InfluenzaA__AHC62662__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccucgugcuaccccuacgacgugccggacuacgcgucccugcggagccucgucgccuccucgggcacgcuggaguucaacaacgaguccuucaacuggaccggggugacccagaacggcaccucguccgccugcauccgcgggagcaacaacuccuucuucucgcggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccggccgcaucaccgugagcacgaagcggucgcagcaggccgugaucccgaacaucggcucccgcccccggguccgcaacauccccagccggguguccaucuacuggaccaucgugaagcccggggacauccugcucaucaacucgaccggcaaccugaucgccccgcgcggguacuucaagauccgguccggcaagucguccaucaugcgcagcgacgcccccaucggcaagugcaacuccgcgugcaucacccccaacgggucgauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacuccgagggccgcgggcaggcggccgaccugaaguccacgcaggccgccaucgaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgggagaacgccgaggacaugggcaacgggugcuucaagaucuaccacaagugcgacaacgccugcaucggcucgauccgcaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcgcugcucggguucaucaugugggccugccagaagggcaacauccgcugcaacaucugcaucuga

SEQ ID NO: 11187 - RNA, 1701 nt, Artificial Sequence
  derived and/or modified CDS sequence (AUadapt) from InfluenzaA__AHC62674__HA
augaagaccaucaucgcccugucguacauccucugccugguguucgcccagaagcugcccggcaacgacaacuccaccgcgacccucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucaucgccucguccggcacgcuggaguucaacaacgagagcuucaacuggaccggggucacccagaacggcaccuccucggccugcauccgcggguccaacaacucguucuucucccggcugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcggccgcaucaccgucuccacgaagcggucgcagcaggccgugaucccgaacaucggcucgcgcccccgggugcgcaacauccccucccgggucagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgugaaccggaucacguacggcgccugcccccgcuacgucaagcagaacacccugaagcucgccaccgggaugcggaacgugcccgagaagcagacccgcggcaucuucggggccaucgccggcuucaucgagaacggcugggaggggaugguggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacacgugcaucgaguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggcgugccagaaggggaacauccgcugcaacaucugcaucuga

SEQ ID NO: 11188 - RNA, 1701 nt, Artificial Sequence; identical to SEQ ID NO: 10305
  derived and/or modified CDS sequence (AUadapt) from InfluenzaA__AHE37972__HA

SEQ ID NO: 11189 - RNA, 1701 nt, Artificial Sequence
  derived and/or modified CDS sequence (AUadapt) from InfluenzaA__AHE37973__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcaccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaucaacuacuacuggacccugaucgagcccggggacaagaucacguucgaggccaccggcaaccucguggugccccgguacgcguucgccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 11190 - RNA, 1701 nt, Artificial Sequence
  derived and/or modified CDS sequence (AUadapt) from InfluenzaA__AHE37974__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagauguuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 11191 - RNA, 1701 nt, Artificial Sequence; identical to SEQ ID NO: 10285
  derived and/or modified CDS sequence (AUadapt) from InfluenzaA__AHE37975__HA

SEQ ID NO: 11192 - RNA, 1701 nt, Artificial Sequence
  derived and/or modified CDS sequence (AUadapt) from InfluenzaA__AHE37976__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccgccgccagcuccuggucguacaucguggagaccuccagcuccaacaacgggaccugcuaccccggcgacuucaucaacuacgaggagcuccgggagcagcugucguccgugucguccuucgagcgcuucgagaucuuccccaagacgagcuccuggcccaaccacgacucgaacaagggcgucaccgccgccugcccgcacgcgggcgccaaguccuucuacaagaaccugaucuggcucgugaagaaggggaacagcuaccccaagcuguccaagucguacaucaacgacaagggcaaggagauccuggugcucugggggauccaccaccccagcaccaccacggaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccugaucgagcccggggacaagaucaccuucgaggcgacgggcaaccucgucgugccccgguacgccuucgccauggagcgcaacgccgggucgggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcggcucgcgacgggccugcgcaacgugccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacucggugaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccggggcaagaucgacggggucaagcucgagagcacccgcaucuaccagauccuggcgaucuacuccaccguggccucgucccuggugcucgucgugagccugggcgccaucucguucuggaugugcuccaacggcagccugcagugccggaucugcaucuga

SEQ ID NO: 11193 - RNA, 1701 nt, Artificial Sequence; identical to SEQ ID NO: 10285
  derived and/or modified CDS sequence (AUadapt) from InfluenzaA__AHE37977__HA

SEQ ID NO: 11194 - RNA, 1701 nt, Artificial Sequence; identical to SEQ ID NO: 10305
  derived and/or modified CDS sequence (AUadapt) from InfluenzaA__AHE37978__HA

SEQ ID NO: 11195 - RNA, 1701 nt, Artificial Sequence; identical to SEQ ID NO: 10285
  derived and/or modified CDS sequence (AUadapt) from InfluenzaA__AHE37979__HA

SEQ ID NO: 11196 - RNA, 1701 nt, Artificial Sequence
  derived and/or modified CDS sequence (AUadapt) from InfluenzaA__AHE37980__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgcggccugcccgcacgccggcgccaaguccuucuacaagaaccugaucuggcucgugaagaaggggaacagcuaccccaagcuguccaagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 11197 - RNA, 1701 nt, Artificial Sequence
  derived and/or modified CDS sequence (AUadapt) from InfluenzaA__AHE37981__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagauguuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggagcggcaucaucaucuccgacacccccguccacgacugcaacacgaccugccagaccccggagggcgccaucaacaccucgcugcccuuccagaacauccaccccaucaccaucgggaagugccccaaguacgugaaguccaccaagcugcgccucgcgacgggccugcggaacgugccgagcauccagucccgcgggcuguucggcgccaucgccggguucaucgagggcggcuggaccgggauggucgacggcugguacggguaccaccaccagaacgagcagggcucgggguacgccgccgaccucaaguccacccagaacgcgaucgacaagaucaccaacaaggugaacagcgugaucgagaagaugaacauccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 11198 - RNA, 1701 nt, Artificial Sequence; identical to SEQ ID NO: 10285
  derived and/or modified CDS sequence (AUadapt) from InfluenzaA__AHE37982__HA

SEQ ID NO: 11199 - RNA, 1701 nt, Artificial Sequence
  derived and/or modified CDS sequence (AUadapt) from InfluenzaA__AHE37983__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccgagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 11200 - RNA, 1701 nt, Artificial Sequence
  derived and/or modified CDS sequence (AUadapt) from InfluenzaA__AHE37984__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 11201 - RNA, 1701 nt, Artificial Sequence
  derived and/or modified CDS sequence (AUadapt) from InfluenzaA__AHE37985__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugaaguccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 11202 - RNA, 1701 nt, Artificial Sequence; identical to SEQ ID NO: 10167
  derived and/or modified CDS sequence (AUadapt) from InfluenzaA__AHE37986__HA

SEQ ID NO: 11203 - RNA, 1701 nt, Artificial Sequence; identical to SEQ ID NO: 10103
  derived and/or modified CDS sequence (AUadapt) from InfluenzaA__AHE37987__HA

SEQ ID NO: 11204 - RNA, 1701 nt, Artificial Sequence
  derived and/or modified CDS sequence (AUadapt) from InfluenzaA__AHE37988__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugauggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccagaaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 11205 - RNA, 1701 nt, Artificial Sequence; identical to SEQ ID NO: 162
  derived and/or modified CDS sequence (AUadapt) from InfluenzaA__AHE37989__HA

SEQ ID NO: 11206 - RNA, 1701 nt, Artificial Sequence; identical to SEQ ID NO: 10103
  derived and/or modified CDS sequence (AUadapt) from InfluenzaA__AHE37990__HA

SEQ ID NO: 11207 - RNA, 1701 nt, Artificial Sequence; identical to SEQ ID NO: 10103
  derived and/or modified CDS sequence (AUadapt) from InfluenzaA__AHE37991__HA

SEQ ID NO: 11208 - RNA, 1701 nt, Artificial Sequence
  derived and/or modified CDS sequence (AUadapt) from InfluenzaA__AHE37992__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucgacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11209 - RNA, 1701 nt, Artificial Sequence; identical to SEQ ID NO: 10285
  derived and/or modified CDS sequence (AUadapt) from InfluenzaA__AHE38023__HA

SEQ ID NO: 11210 - RNA, 1701 nt, Artificial Sequence
  derived and/or modified CDS sequence (AUadapt) from InfluenzaA__AHE38024__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccacccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacgcagaacgccaucgacaagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 11211 - RNA, 1701 nt, Artificial Sequence
  derived and/or modified CDS sequence (AUadapt) from InfluenzaA__AHE38026__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgagaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 11212 - RNA, 1701 nt, Artificial Sequence; identical to SEQ ID NO: 10128
  derived and/or modified CDS sequence (AUadapt) from InfluenzaA__AHE38027__HA

SEQ ID NO: 11213 - RNA, 1683 nt, Artificial Sequence
  derived and/or modified CDS sequence (AUadapt) from InfluenzaA__AHF20558__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuucucgaauucagcgccgaccugaucaucgagcgccgggagggguccgacgugugcuaccccggcaaguucgugaacgaggaggcccugcgccagauccuccgggagagugggggcaucgacaaggaggcgaugggguucaccuacuccggcauccgcaccaacggcgccaccagcgccugccggcgcuccgggagcuccuucuaugccgagaugaaguggcugcugagcaacacggacaacgcggccuucccgcagaugaccaaauccuacaagaacacccgcaagagccccgcccucaucgucuggggcauccaucacuccgugagcaccgccgagcagacgaagcuguacggguccggcaacaagcuggugaccgucggcagcuccaacuaccagcagagcuuugugcccucccccggggcccggccccaggugaacggccucagcgggcggaucgacuuccacuggcugaugcugaaccccaacgacaccgucaccuuuagcuucaacggcgcguucaucgcccccgaccgcgccuccuuccuccggggcaagagcauggggauccaguccggcguccaaguggacgccaauugcgagggggacugcuaccacagcggcgggacgaucaucuccaaccugcccuuucagaacaucgacagccgcgccgugggcaagugcccgcgguacgugaagcagcgcucccugcuccuggcgaccgggaugaagaacgugcccgagauccccaagggccggggccuguucggggccaucgccggcuucaucgagaaugggugggagggccucaucgacgggugguacggcuuccgccaccagaacgcccagggcgaagggaccgccgcggacuacaagagcacccaguccgccaucgaucagaucacgggcaagcugaaccggcugaucgagaagaccaaccagcaguucgagcucaucgacaacgaguucaacgaggucgaaaagcagaucgggaacgugaucaauuggacccgcgacagcaucaccgaggugugguccuacaacgccgagcugcuggucgccauggagaaccagcacacgaucgaccucgccgacagugagauggacaagcuguacgagcgcgugaagcggcagcugcgcgagaacgcggaagaggacggcaccggcugcuucgagaucuuccacaagugugacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugcagaacggcaacaugcgcugcaccaucgggaucuga

SEQ ID NO: 11214 - RNA, 1683 nt, Artificial Sequence
  derived and/or modified CDS sequence (AUadapt) from InfluenzaA__AHF20568__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggaaggguccgacgugugcuaccccggcaaguucgugaacgaggaggcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggauaacgcggccuucccgcagaugaccaaguccuacaagaacacccgcaagagccccgcccucaucgucuggggcauccaccacuccgugagcaccgccgagcaaacgaagcuguauggguccggcaacaagcuggugaccgucggcagcuccaacuaccagcagagcuucgugcccucccccggggcccggccccaggugaacggccucagcgggcggaucgacuuucacuggcugaugcugaaccccaacgacaccgucaccuucagcuucaacggcgcguuuaucgcccccgaccgcgccuccuuccuccggggcaagagcauggggauccaguccggcguccagguggacgccaacugcgagggggacugcuaccauagcggcgggacgaucauguccaaccugcccuuccagaacaucgacagccgcgccgugggcaagugcccgcgguacgugaagcagcgcucccugcuccuggcgaccgggaugaagaaugugcccgaaauccccaagggccggggccuguucggggccaucgccggcuucaucgagaacgggugggagggccucaucgacgggugguacggcuuccgccaccagaacgcccagggcgaggggaccgccgcggacuauaagagcacccaguccgccaucgaccagaucacgggcaagcugaaccggcugaucgagaagaccaaccagcaauucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaagcuguacgagcgcgugaagcggcaacugcgcgagaacgcggaggaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 11215 - RNA, 1698 nt, Artificial Sequence; identical to SEQ ID NO: 8038
  derived and/or modified CDS sequence (AUadapt) from InfluenzaA__AHG96108__HA

SEQ ID NO: 11216 - RNA, 1698 nt, Artificial Sequence; identical to SEQ ID NO: 8038
  derived and/or modified CDS sequence (AUadapt) from InfluenzaA__AHG96120__HA

SEQ ID NO: 11217 - RNA, 1698 nt, Artificial Sequence; identical to SEQ ID NO: 8038
  derived and/or modified CDS sequence (AUadapt) from InfluenzaA__AHG96132__HA

SEQ ID NO: 11218 - RNA, 1698 nt, Artificial Sequence
  derived and/or modified CDS sequence (AUadapt) from InfluenzaA__AHG96144__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacucgcggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 11219 - RNA, 1698 nt, Artificial Sequence; identical to SEQ ID NO: 8038
  derived and/or modified CDS sequence (AUadapt) from InfluenzaA__AHG96156__HA

SEQ ID NO: 11220 - RNA, 1698 nt, Artificial Sequence; identical to SEQ ID NO: 8038
  derived and/or modified CDS sequence (AUadapt) from InfluenzaA__AHG96168__HA

SEQ ID NO: 11221 - RNA, 1698 nt, Artificial Sequence; identical to SEQ ID NO: 8038
  derived and/or modified CDS sequence (AUadapt) from InfluenzaA__AHG96180__HA

SEQ ID NO: 11222 - RNA, 1698 nt, Artificial Sequence; identical to SEQ ID NO: 8038
  derived and/or modified CDS sequence (AUadapt) from InfluenzaA__AHG96192__HA

SEQ ID NO: 11223 - RNA, 1698 nt, Artificial Sequence; identical to SEQ ID NO: 8038
  derived and/or modified CDS sequence (AUadapt) from InfluenzaA__AHG96204__HA

SEQ ID NO: 11224 - RNA, 1698 nt, Artificial Sequence; identical to SEQ ID NO: 8038
  derived and/or modified CDS sequence (AUadapt) from InfluenzaA__AHG96216__HA

SEQ ID NO: 11225 - RNA, 1698 nt, Artificial Sequence; identical to SEQ ID NO: 8038
  derived and/or modified CDS sequence (AUadapt) from InfluenzaA__AHG96228__HA

SEQ ID NO: 11226 - RNA, 1698 nt, Artificial Sequence; identical to SEQ ID NO: 11218
  derived and/or modified CDS sequence (AUadapt) from InfluenzaA__AHG96240__HA

SEQ ID NO: 11227 - RNA, 1698 nt, Artificial Sequence; identical to SEQ ID NO: 8038
  derived and/or modified CDS sequence (AUadapt) from InfluenzaA__AHG96252__HA

SEQ ID NO: 11228 - RNA, 1698 nt, Artificial Sequence; identical to SEQ ID NO: 8038
  derived and/or modified CDS sequence (AUadapt) from InfluenzaA__AHG96264__HA

SEQ ID NO: 11229 - RNA, 1698 nt, Artificial Sequence; identical to SEQ ID NO: 8038
  derived and/or modified CDS sequence (AUadapt) from InfluenzaA__AHG96276__HA

SEQ ID NO: 11230 - RNA, 1698 nt, Artificial Sequence; identical to SEQ ID NO: 8038
  derived and/or modified CDS sequence (AUadapt) from InfluenzaA__AHG96288__HA

SEQ ID NO: 11231 - RNA, 1698 nt, Artificial Sequence; identical to SEQ ID NO: 8038
  derived and/or modified CDS sequence (AUadapt) from InfluenzaA__AHG96300__HA

SEQ ID NO: 11232 - RNA, 1701 nt, Artificial Sequence
  derived and/or modified CDS sequence (AUadapt) from InfluenzaA__AHG96312__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgugccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgucagcuccuucgagcgcuucgagaucuuccccaagaccucguccuggcccaaccacgacagcaacaagggggugaccgcggccugcccgcacgccggcgccaaguccuucuacaagaaccugaucuggcucgugaagaaggggaacucguaccccaagcugucccagagcuacaucaacgacaagggcaaggagguccuggugcucugggggauccaccaccccucgaccacggcggaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggccucgucccuggugcucgucgugagccugggggcgaucucguucuggaugugcuccaacggcagccugcagugccggaucugcaucuga

SEQ ID NO: 11233 - RNA, 1701 nt, Artificial Sequence; identical to SEQ ID NO: 10285
  derived and/or modified CDS sequence (AUadapt) from InfluenzaA__AHG96313__HA

SEQ ID NO: 11234 - RNA, 1701 nt, Artificial Sequence
  derived and/or modified CDS sequence (AUadapt) from InfluenzaA__AHG96314__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguacaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 11235 - RNA, 1701 nt, Artificial Sequence; identical to SEQ ID NO: 10285
  derived and/or modified CDS sequence (AUadapt) from InfluenzaA__AHG96315__HA

SEQ ID NO: 11236 - RNA, 1701 nt, Artificial Sequence; identical to SEQ ID NO: 10285
  derived and/or modified CDS sequence (AUadapt) from InfluenzaA__AHG96316__HA

SEQ ID NO: 11237 - RNA, 1701 nt, Artificial Sequence; identical to SEQ ID NO: 10285
  derived and/or modified CDS sequence (AUadapt) from InfluenzaA__AHG96317__HA

SEQ ID NO: 11238 - RNA, 1701 nt, Artificial Sequence; identical to SEQ ID NO: 10285
  derived and/or modified CDS sequence (AUadapt) from InfluenzaA__AHG96320__HA

SEQ ID NO: 11239 - RNA, 1701 nt, Artificial Sequence; identical to SEQ ID NO: 10285
  derived and/or modified CDS sequence (AUadapt) from InfluenzaA__AHG96321__HA

SEQ ID NO: 11240 - RNA, 1701 nt, Artificial Sequence; identical to SEQ ID NO: 10285
  derived and/or modified CDS sequence (AUadapt) from InfluenzaA__AHG96322__HA

SEQ ID NO: 11241 - RNA, 1701 nt, Artificial Sequence; identical to SEQ ID NO: 10285
  derived and/or modified CDS sequence (AUadapt) from InfluenzaA__AHG96324__HA

SEQ ID NO: 11242 - RNA, 1701 nt, Artificial Sequence; identical to SEQ ID NO: 10285
  derived and/or modified CDS sequence (AUadapt) from InfluenzaA__AHG96325__HA

SEQ ID NO: 11243 - RNA, 1701 nt, Artificial Sequence
  derived and/or modified CDS sequence (AUadapt) from InfluenzaA__AHG96326__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccaacucggacaacggcacgugcuaccccggcgacuucaucaacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugucgcaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 11244 - RNA, 1701 nt, Artificial Sequence; identical to SEQ ID NO: 10285
  derived and/or modified CDS sequence (AUadapt) from InfluenzaA__AHG96327__HA

SEQ ID NO: 11245 - RNA, 1701 nt, Artificial Sequence
  derived and/or modified CDS sequence (AUadapt) from InfluenzaA__AHG96329__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagauccgcaaccagcugaagaacaacgccaaggagaucgggaacggcugcuucgaguucuaccacaagugcgacaacacgugcauggagucggucaagaacgggaccuacgaguaccccaaguacuccgaggaggccaagcugaaccgggagaagaucgacggcgugaagcucgagagcaccaagaucuaccagauccuggccaucuacuccaccguggccucgucccugguccucguggugagccugggggcgaucucguucuggaugugcuccaacggcagccugcagugccgcaucugcaucuga

SEQ ID NO: 11246 - RNA, 1701 nt, Artificial Sequence
  derived and/or modified CDS sequence (AUadapt) from InfluenzaA__AHG96330__HA
augaaggccauccuggugguccuccuguacaccuucgccaccgcgacggccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgacgaccgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugagccucgccaccggccugcggaacgucccguccauccagucgcgcgggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacucgaacgugaagaaccucuacgagaagauccggaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgagaagaucgacggcgugaagcucgaguccacccggaucuaccagauccuggccaucuacucgaccguggcguccagccugguccucguggugucgcugggggccaucuccuucuggaugugcagcaacggcucccugcagugccgcaucugcaucuga

SEQ ID NO: 11247 - RNA, 1701 nt, Artificial Sequence; identical to SEQ ID NO: 10285
  derived and/or modified CDS sequence (AUadapt) from InfluenzaA__AHG96332__HA

SEQ ID NO: 11248 - RNA, 1701 nt, Artificial Sequence
  derived and/or modified CDS sequence (AUadapt) from InfluenzaA__AHG96334__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccucaucuggcuggugaagaaggggaacucguaccccaagcugucccagagcuacaucaacgacaagggcaaggaggugcucguccugugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcuccggcuggccaccggccugcgcaacgucccgagcauccagucccggggccucuucggggcgaucgccggguucaucgagggcggcuggaccgggaugguggacggcugguacggguaccaccaccagaacgagcagggcucgggguacgccgccgaccugaaguccacccagaacgccaucgacaagaucacgaacaaggugaacucggucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagucgacccgcaucuaccagauccuggccaucuacuccaccgucgcgucgucccucgugcugguggucagccugggggccaucucguucuggaugugcuccaacggcagccuccagugccggaucugcaucuga

SEQ ID NO: 11249 - RNA, 1701 nt, Artificial Sequence
  derived and/or modified CDS sequence (AUadapt) from InfluenzaA__AHG96335__HA
augaaggccauccuggugguccuccuguacaccuucgagaccgccaacgcggacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgcgagcagcugucguccgugucguccuucgagcgguucgagaucuuccccaagaccagcuccuggcccaaccacgacucgaacaagggggucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcaccacggcggaccagcagucccuguaccagaacgccgacgccuacguguucgugggcaccucgcgcuacuccaagaaguucaagcccgagaucgccauccggccgaagguccgcgaccaggagggccggaugaacuacuacuggacccugguggagcccggggacaagaucaccuucgaggccacgggcaaccucguggucccccgcuacgcguucaccauggagcggaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgucgauccagucccgcgggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgccgugggcaaggaguucaaccaccuggagaagcggaucgagaaccugaacaagaaggucgacgacggcuuccucgacaucuggaccuacaacgcggagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgccucgucccuggugcucguggucagccugggggcgaucucguucuggaugugcuccaacggcagccugcagugccgcaucugcaucuga

SEQ ID NO: 11250 - RNA, 1701 nt, Artificial Sequence
  derived and/or modified CDS sequence (AUadapt) from InfluenzaA__AHG96336__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcgggacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgucccuggugcucguggucagccugggggccaucucguucuggaugugcuccaacggcagccugcagugccgcaucugcaucuga

SEQ ID NO: 11251 - RNA, 1701 nt, Artificial Sequence
  derived and/or modified CDS sequence (AUadapt) from InfluenzaA__AHG96338__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcucccacgccggcgccaagucguucuacaagaaccugaucuggcucgugaagaaggggaacuccuacccgaagcugagccagucguacaucaacgacaagggcaaggaggugcugguccucugggggauccaccaccccuccaccacggccgaccagcagucgcuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucaccauggagcgcaacgccggguccggcaucaucaucucggacacccccgugcacgacugcaacaccacgugccagacccccgagggcgccaucaacaccucccugccguuccagaacauccaccccaucaccaucgggaagugccccaaguacgucaagagcacgaagcugcggcucgccaccggccugcgcaacgugcccuccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 11252 - RNA, 1701 nt, Artificial Sequence
  derived and/or modified CDS sequence (AUadapt) from InfluenzaA__AHG96339__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggagauccuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 11253 - RNA, 1701 nt, Artificial Sequence; identical to SEQ ID NO: 10285
  derived and/or modified CDS sequence (AUadapt) from InfluenzaA__AHG96340__HA

SEQ ID NO: 11254 - RNA, 1701 nt, Artificial Sequence
  derived and/or modified CDS sequence (AUadapt) from InfluenzaA__AHG96341__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgaaguacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacaucccgucgauccagucccgcgggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggccaucuacuccaccguggcgucgucccugguccucguggugagccugggggccaucucguucuggaugugcuccaacggcagccugcagugccgcaucugcaucuga

SEQ ID NO: 11255 - RNA, 1701 nt, Artificial Sequence
  derived and/or modified CDS sequence (AUadapt) from InfluenzaA__AHG96342__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacaugugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 11256 - RNA, 1701 nt, Artificial Sequence
  derived and/or modified CDS sequence (AUadapt) from InfluenzaA__AHG96343__HA
augaaggccauccuggugguccuccuguacaccuucgccaccgcgacggccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacguccaacucggacaacgggaccugcuaccccggcgacuucaucaacuacgaggagcuccgggagcagcuguccagcguguccucguucgagcgcuucgagaucuuccccaagaccuccagcuggcccaaccacgacuccaacaagggcgucaccgccgccugcccgcacgccggcgccaagucguucuacaagaaccugaucuggcucgugaagaaggggaacuccuaccccaagcugucgcaguccuacaucaacgacaagggcaaggaggugcugguccucugggggauccaccaccccagcacgaccgccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagucgaccaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 11257 - RNA, 1701 nt, Artificial Sequence; identical to SEQ ID NO: 10285
  derived and/or modified CDS sequence (AUadapt) from InfluenzaA__AHG96344__HA

SEQ ID NO: 11258 - RNA, 1701 nt, Artificial Sequence; identical to SEQ ID NO: 11248
  derived and/or modified CDS sequence (AUadapt) from InfluenzaA__AHG96345__HA

SEQ ID NO: 11259 - RNA, 1701 nt, Artificial Sequence; identical to SEQ ID NO: 10285
  derived and/or modified CDS sequence (AUadapt) from InfluenzaA__AHG96346__HA

SEQ ID NO: 11260 - RNA, 1701 nt, Artificial Sequence; identical to SEQ ID NO: 10285
  derived and/or modified CDS sequence (AUadapt) from InfluenzaA__AHG96347__HA

SEQ ID NO: 11261 - RNA, 1701 nt, Artificial Sequence; identical to SEQ ID NO: 10285
  derived and/or modified CDS sequence (AUadapt) from InfluenzaA__AHG96348__HA

SEQ ID NO: 11262 - RNA, 1701 nt, Artificial Sequence; identical to SEQ ID NO: 10285
  derived and/or modified CDS sequence (AUadapt) from InfluenzaA__AHG96349__HA

SEQ ID NO: 11263 - RNA, 1701 nt, Artificial Sequence; identical to SEQ ID NO: 10285
  derived and/or modified CDS sequence (AUadapt) from InfluenzaA__AHG96350__HA

SEQ ID NO: 11264 - RNA, 1701 nt, Artificial Sequence; identical to SEQ ID NO: 10285
  derived and/or modified CDS sequence (AUadapt) from InfluenzaA__AHG96351__HA

SEQ ID NO: 11265 - RNA, 1701 nt, Artificial Sequence; identical to SEQ ID NO: 10285
  derived and/or modified CDS sequence (AUadapt) from InfluenzaA__AHG96352__HA

SEQ ID NO: 11266 - RNA, 1701 nt, Artificial Sequence
  derived and/or modified CDS sequence (AUadapt) from InfluenzaA__AHG96353__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 11267 - RNA, 1701 nt, Artificial Sequence; identical to SEQ ID NO: 10285
  derived and/or modified CDS sequence (AUadapt) from InfluenzaA__AHG96354__HA

SEQ ID NO: 11268 - RNA, 1701 nt, Artificial Sequence
  derived and/or modified CDS sequence (AUadapt) from InfluenzaA__AHG96355__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccucaucuggcuggugaagaaggggaacucguaccccaagcugucccagagcuacaucaacgacaagggcaaggaggugcucguccugugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcuccggcuggccaccggccugcgcaacgucccgagcauccagucccggggccucuucggggcgaucgccggguucaucgagggcggcuggaccgggaugguggacggcugguacggguaccaccaccagaacgagcagggcucgggguacgccgccgaccugaaguccacccagaacgccaucgacaagaucacgaacaaggugaacucggucaucgagaagaugaacacccaguucaccgcggugggcaaggaguucaaccagcuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagucgacccgcaucuaccagauccuggccaucuacuccaccgucgcgucgucccucgugcugguggucagccugggggccaucucguucuggaugugcuccaacggcagccuccagugccggaucugcaucuga

SEQ ID NO: 11269 - RNA, 1701 nt, Artificial Sequence; identical to SEQ ID NO: 10103
  derived and/or modified CDS sequence (AUadapt) from InfluenzaA__AHG96356__HA

SEQ ID NO: 11270 - RNA, 1701 nt, Artificial Sequence
  derived and/or modified CDS sequence (AUadapt) from InfluenzaA__AHG96359__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacgacgagagcuucaacuggaccggcgugacccagaacgggaccuccucguccugcaagcgccggagcaacaacuccuucuucucgcgccugaacuggcucacgcaccugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcucgcagcagaccgucaucccgaacaucggcucccggccccgcauccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 11271 - RNA, 1701 nt, Artificial Sequence; identical to SEQ ID NO: 11270
  derived and/or modified CDS sequence (AUadapt) from InfluenzaA__AHG96371__HA

SEQ ID NO: 11272 - RNA, 1701 nt, Artificial Sequence; identical to SEQ ID NO: 11270
  derived and/or modified CDS sequence (AUadapt) from InfluenzaA__AHG96383__HA

SEQ ID NO: 11273 - RNA, 1698 nt, Artificial Sequence; identical to SEQ ID NO: 8038
  derived and/or modified CDS sequence (AUadapt) from InfluenzaA__AHG96395__HA

SEQ ID NO: 11274 - RNA, 1701 nt, Artificial Sequence; identical to SEQ ID NO: 11270
  derived and/or modified CDS sequence (AUadapt) from InfluenzaA__AHG96407__HA

SEQ ID NO: 11275 - RNA, 1701 nt, Artificial Sequence; identical to SEQ ID NO: 11270
  derived and/or modified CDS sequence (AUadapt) from InfluenzaA__AHG96419__HA

SEQ ID NO: 11276 - RNA, 1701 nt, Artificial Sequence; identical to SEQ ID NO: 11270
  derived and/or modified CDS sequence (AUadapt) from InfluenzaA__AHG96431__HA

SEQ ID NO: 11277 - RNA, 1701 nt, Artificial Sequence; identical to SEQ ID NO: 11270
  derived and/or modified CDS sequence (AUadapt) from InfluenzaA__AHG96443__HA

SEQ ID NO: 11278 - RNA, 1701 nt, Artificial Sequence; identical to SEQ ID NO: 11270
  derived and/or modified CDS sequence (AUadapt) from InfluenzaA__AHG96455__HA

SEQ ID NO: 11279 - RNA, 1701 nt, Artificial Sequence; identical to SEQ ID NO: 11270
  derived and/or modified CDS sequence (AUadapt) from InfluenzaA__AHG96467__HA

SEQ ID NO: 11280 - RNA, 1701 nt, Artificial Sequence; identical to SEQ ID NO: 11270
  derived and/or modified CDS sequence (AUadapt) from InfluenzaA__AHG96479__HA

SEQ ID NO: 11281 - RNA, 1701 nt, Artificial Sequence; identical to SEQ ID NO: 11270
  derived and/or modified CDS sequence (AUadapt) from InfluenzaA__AHG96491__HA

SEQ ID NO: 11282 - RNA, 1701 nt, Artificial Sequence; identical to SEQ ID NO: 2601
  derived and/or modified CDS sequence (AUadapt) from InfluenzaA__AHG96503__HA

SEQ ID NO: 11283 - RNA, 1698 nt, Artificial Sequence; identical to SEQ ID NO: 8038
  derived and/or modified CDS sequence (AUadapt) from InfluenzaA__AHG96515__HA

SEQ ID NO: 11284 - RNA, 1698 nt, Artificial Sequence; identical to SEQ ID NO: 8038
  derived and/or modified CDS sequence (AUadapt) from InfluenzaA__AHG96527__HA

SEQ ID NO: 11285 - RNA, 1698 nt, Artificial Sequence; identical to SEQ ID NO: 8038
  derived and/or modified CDS sequence (AUadapt) from InfluenzaA__AHG96539__HA

SEQ ID NO: 11286 - RNA, 1698 nt, Artificial Sequence; identical to SEQ ID NO: 8038
  derived and/or modified CDS sequence (AUadapt) from InfluenzaA__AHG96551__HA

SEQ ID NO: 11287 - RNA, 1698 nt, Artificial Sequence; identical to SEQ ID NO: 11218
  derived and/or modified CDS sequence (AUadapt) from InfluenzaA__AHG96563__HA

SEQ ID NO: 11288 - RNA, 1698 nt, Artificial Sequence; identical to SEQ ID NO: 8038
  derived and/or modified CDS sequence (AUadapt) from InfluenzaA__AHG96575__HA

SEQ ID NO: 11289 - RNA, 1698 nt, Artificial Sequence; identical to SEQ ID NO: 8038
  derived and/or modified CDS sequence (AUadapt) from InfluenzaA__AHG96587__HA

SEQ ID NO: 11290 - RNA, 1698 nt, Artificial Sequence; identical to SEQ ID NO: 8038
  derived and/or modified CDS sequence (AUadapt) from InfluenzaA__AHG96599__HA

SEQ ID NO: 11291 - RNA, 1698 nt, Artificial Sequence; identical to SEQ ID NO: 8038
  derived and/or modified CDS sequence (AUadapt) from InfluenzaA__AHG96611__HA

SEQ ID NO: 11292 - RNA, 1698 nt, Artificial Sequence; identical to SEQ ID NO: 8038
  derived and/or modified CDS sequence (AUadapt) from InfluenzaA__AHG96623__HA

SEQ ID NO: 11293 - RNA, 1698 nt, Artificial Sequence; identical to SEQ ID NO: 8038
  derived and/or modified CDS sequence (AUadapt) from InfluenzaA__AHG96635__HA

SEQ ID NO: 11294 - RNA, 1698 nt, Artificial Sequence; identical to SEQ ID NO: 8038
  derived and/or modified CDS sequence (AUadapt) from InfluenzaA__AHG96647__HA

SEQ ID NO: 11295 - RNA, 1698 nt, Artificial Sequence; identical to SEQ ID NO: 8038
  derived and/or modified CDS sequence (AUadapt) from InfluenzaA__AHG96659__HA

SEQ ID NO: 11296 - RNA, 1698 nt, Artificial Sequence; identical to SEQ ID NO: 8038
  derived and/or modified CDS sequence (AUadapt) from InfluenzaA__AHG96671__HA

SEQ ID NO: 11297 - RNA, 1698 nt, Artificial Sequence; identical to SEQ ID NO: 8038
  derived and/or modified CDS sequence (AUadapt) from InfluenzaA__AHG96683__HA

SEQ ID NO: 11298 - RNA, 1701 nt, Artificial Sequence; identical to SEQ ID NO: 11270
  derived and/or modified CDS sequence (AUadapt) from InfluenzaA__AHG96695__HA

SEQ ID NO: 11299 - RNA, 1701 nt, Artificial Sequence; identical to SEQ ID NO: 11270
  derived and/or modified CDS sequence (AUadapt) from InfluenzaA__AHG96707__HA

SEQ ID NO: 11300 - RNA, 1701 nt, Artificial Sequence; identical to SEQ ID NO: 11270
  derived and/or modified CDS sequence (AUadapt) from InfluenzaA__AHG96719__HA

SEQ ID NO: 11301 - RNA, 1701 nt, Artificial Sequence; identical to SEQ ID NO: 11270
  derived and/or modified CDS sequence (AUadapt) from InfluenzaA__AHG96731__HA

SEQ ID NO: 11302 - RNA, 1701 nt, Artificial Sequence; identical to SEQ ID NO: 11270
  derived and/or modified CDS sequence (AUadapt) from InfluenzaA__AHG96743__HA

SEQ ID NO: 11303 - RNA, 1701 nt, Artificial Sequence; identical to SEQ ID NO: 11270
  derived and/or modified CDS sequence (AUadapt) from InfluenzaA__AHG96755__HA

SEQ ID NO: 11304 - RNA, 1701 nt, Artificial Sequence; identical to SEQ ID NO: 11270
  derived and/or modified CDS sequence (AUadapt) from InfluenzaA__AHG96767__HA

SEQ ID NO: 11305 - RNA, 1701 nt, Artificial Sequence; identical to SEQ ID NO: 11270
  derived and/or modified CDS sequence (AUadapt) from InfluenzaA__AHG96779__HA

SEQ ID NO: 11306 - RNA, 1701 nt, Artificial Sequence
  derived and/or modified CDS sequence (AUadapt) from InfluenzaA__AHG96791__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacgacgagagcuucaacuggaccggcgugacccagaacgggaccuccucguccugcaagcgccggagcaacaacuccuucuucucgcgccugaacuggcucacgcagcugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcucgcagcagaccgucaucccgaacaucggcucccggccccgcauccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagcgccggauccaggaccuggagaaguacguggaggacaccaagaucgaccuguggucguacaacgccgagcuccugguggcccuggagaaccagcacacgaucgaccucaccgacuccgagaugaacaagcuguucgagcgcaccaagaagcagcugcgcgagaacgccgaggacaugggcaacgggugcuucaagaucuaccacaagugcgacaacgccugcaucggcagcauccggaacgggaccuacgaccacgacgucuaccgcgacgaggcgcucaacaaccgguuccagaucaagggcguggagcugaaguccggguacaaggacuggauccuguggaucagcuucgccaucuccugcuuccuccugugcguggcccugcucggcuucaucaugugggccugccagaagggcaacauccgcugcaacaucugcaucuga

SEQ ID NO: 11307 - RNA, 1701 nt, Artificial Sequence; identical to SEQ ID NO: 11270
  derived and/or modified CDS sequence (AUadapt) from InfluenzaA__AHG96803__HA

SEQ ID NO: 11308 - RNA, 1701 nt, Artificial Sequence; identical to SEQ ID NO: 11270
  derived and/or modified CDS sequence (AUadapt) from InfluenzaA__AHG96815__HA

SEQ ID NO: 11309 - RNA, 1701 nt, Artificial Sequence; identical to SEQ ID NO: 11270
  derived and/or modified CDS sequence (AUadapt) from InfluenzaA__AHG96827__HA

SEQ ID NO: 11310 - RNA, 1701 nt, Artificial Sequence; identical to SEQ ID NO: 11270
  derived and/or modified CDS sequence (AUadapt) from InfluenzaA__AHG96839__HA

SEQ ID NO: 11311 - RNA, 1701 nt, Artificial Sequence; identical to SEQ ID NO: 11270
  derived and/or modified CDS sequence (AUadapt) from InfluenzaA__AHG96851__HA

SEQ ID NO: 11312 - RNA, 1701 nt, Artificial Sequence; identical to SEQ ID NO: 11270
  derived and/or modified CDS sequence (AUadapt) from InfluenzaA__AHG96863__HA

SEQ ID NO: 11313 - RNA, 1701 nt, Artificial Sequence; identical to SEQ ID NO: 11270
  derived and/or modified CDS sequence (AUadapt) from InfluenzaA__AHG96875__HA

SEQ ID NO: 11314 - RNA, 1701 nt, Artificial Sequence; identical to SEQ ID NO: 11270
  derived and/or modified CDS sequence (AUadapt) from InfluenzaA__AHG96887__HA

SEQ ID NO: 11315 - RNA, 1701 nt, Artificial Sequence; identical to SEQ ID NO: 11270
  derived and/or modified CDS sequence (AUadapt) from InfluenzaA__AHG96899__HA

SEQ ID NO: 11316 - RNA, 1701 nt, Artificial Sequence; identical to SEQ ID NO: 11270
  derived and/or modified CDS sequence (AUadapt) from InfluenzaA__AHG96911__HA

SEQ ID NO: 11317 - RNA, 1701 nt, Artificial Sequence; identical to SEQ ID NO: 11270
  derived and/or modified CDS sequence (AUadapt) from InfluenzaA__AHG96923__HA

SEQ ID NO: 11318 - RNA, 1701 nt, Artificial Sequence; identical to SEQ ID NO: 11270
  derived and/or modified CDS sequence (AUadapt) from InfluenzaA__AHG96935__HA

SEQ ID NO: 11319 - RNA, 1701 nt, Artificial Sequence; identical to SEQ ID NO: 11270
  derived and/or modified CDS sequence (AUadapt) from InfluenzaA__AHG96947__HA

SEQ ID NO: 11320 - RNA, 1701 nt, Artificial Sequence; identical to SEQ ID NO: 11270
  derived and/or modified CDS sequence (AUadapt) from InfluenzaA__AHG96959__HA

SEQ ID NO: 11321 - RNA, 1701 nt, Artificial Sequence; identical to SEQ ID NO: 11270
  derived and/or modified CDS sequence (AUadapt) from InfluenzaA__AHG96971__HA

SEQ ID NO: 11322 - RNA, 1701 nt, Artificial Sequence; identical to SEQ ID NO: 11270
  derived and/or modified CDS sequence (AUadapt) from InfluenzaA__AHG96983__HA

SEQ ID NO: 11323 - RNA, 1701 nt, Artificial Sequence; identical to SEQ ID NO: 11270
  derived and/or modified CDS sequence (AUadapt) from InfluenzaA__AHG96995__HA

SEQ ID NO: 11324 - RNA, 1701 nt, Artificial Sequence; identical to SEQ ID NO: 11270
  derived and/or modified CDS sequence (AUadapt) from InfluenzaA__AHG97007__HA

SEQ ID NO: 11325 - RNA, 1701 nt, Artificial Sequence; identical to SEQ ID NO: 11270
  derived and/or modified CDS sequence (AUadapt) from InfluenzaA__AHG97019__HA

SEQ ID NO: 11326 - RNA, 1701 nt, Artificial Sequence; identical to SEQ ID NO: 11270
  derived and/or modified CDS sequence (AUadapt) from InfluenzaA__AHG97031__HA

SEQ ID NO: 11327 - RNA, 1701 nt, Artificial Sequence; identical to SEQ ID NO: 11270
  derived and/or modified CDS sequence (AUadapt) from InfluenzaA__AHG97043__HA

SEQ ID NO: 11328 - RNA, 1701 nt, Artificial Sequence
  derived and/or modified CDS sequence (AUadapt) from InfluenzaA__AHH00866__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcuccgcucccugguggccagcuccggcacgcuggaguucaacaacgagucguucaacuggaccggggucgcccagaacggcaccuccucggcgugcaagcggcgcuccaucaagagcuucuucucccggcucaacuggcugcaccagcuggagaaccgcuaccccgcccucaacgugaccaugcccaacaacgacaaguucgacaagcuguacaucuggggcgugcaccaccccucgacggacuccgaccagaucagcgucuacgcccaggccucggggcgggugaccguguccaccaagcgcagccagcagaccgucaucccgaacaucgggucccggcccugggugcgcggcaucucgucccggaucucgaucuacuggacgaucgugaaccccggcgacauccugcucaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 11329 - RNA, 1701 nt, Artificial Sequence
  derived and/or modified CDS sequence (AUadapt) from InfluenzaA__AHH00870__HA
augaagaccaucaucgcccugucguacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagucguccagcaccgggcgcaucugcgacucgccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccucgcuccgcucccugguggccagcuccggcacgcuggaguucaacaacgagucguucaacuggaccggggucgcccagaacggcaccuccucggcgugcaagcggcgcuccaucaagagcuucuucucccggcucaacuggcugcaccagcuggagaaccgcuaccccgcccucaacgugaccaugcccaacaacgacaaguucgacaagcuguacaucuggggcgugcaccaccccucgacggacuccgaccagaucagcgucuacgcccaggccucggggcgggugaccguguccaccaagcgcagccagcagaccgucaucccgaacaucgggucccggcccugggugcgcggcaucucgucccggaucucgaucuacuggacgaucgugaagcccggcgacauccugcucaucaacuccaccgggaaccugaucgcgccccgcggcuacuucaagauccggagcgggaaguccucgaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacucggaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 11330 - RNA, 1701 nt, Artificial Sequence
  derived and/or modified CDS sequence (AUadapt) from InfluenzaA__AHJ57430__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugccgccugcggggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucaacuacgaggagcuccgcgagcagcugucguccgugagcuccuucgagcgguucgagaucucgcccaagaccuccucguggcccaaccacgacuccaacaaggggguccgcgccgccugcccgcacgccggcgccaagagcuucuacaagaaccugaucuggcucgugaagaaggggaacuccuaccccaagcugucgaagagcuacaucaacgacaagggcaaggaggugcugguccucugggggauccaccaccccuccaccucggccgaccagcagucccuguaccagaacgccgacgccuacguguucgugggcaccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccgccucgggcaucaucaucuccgacacccccgugcacgacugcaacacgaccugccagaccccgaagggcgcggugaacaccagccugcccuuccagaacauccaccccaucacgaucgggaagugccccaaguacgucaaguccaccaagcugcggcucgccaccggccugcgcaacaucccgucgauccagucccgggggcuguucggcgccaucgccggguucaucgagggcggcuggaccgggaugguggacggcugguacggguaccaccaccagaacgagcagggcucgggguacgccgcggaccucaaguccacgcagaacgccaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcaacaacacgugcauggaguccgugaagaacgggaccuacgacuaccccaaguacagcgaggaggcgaagcugaaccgggagaagaucgacggcgugaagcucgaguccacccgcaucuaccagauccuggccaucuacucgaccgucgccagcucccuggugcucguggucucgcugggggccaucuccuucuggaugugcagcaacggcucccugcagugccggaucugcaucuga

SEQ ID NO: 11331 - RNA, 1701 nt, Artificial Sequence
  derived and/or modified CDS sequence (AUadapt) from InfluenzaA__AHJ57431__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaaggggguccgggccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccuccgccgaccagcagucgcuguaccagaacgccgacgccuacguguucgugggcaccucccgcuacagcaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcgccucgcgaccggccugcggaacaucccguccauccagucgcgcgggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgugaucgagaagaugaacacccaguucaccgccgucggcaaggaguucaaccaccuggagaagcggaucgagaaccugaacaagaagguggacgacggcuuccucgacaucuggacguacaacgccgagcugcugguccuccuggagaacgagcgcacccuggacuaccacgacucgaacgugaagaaccucuacgagaaggugcggaaccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgcgagaagaucgacggcgugaagcucgaguccacccggaucuaccagauccuggcgaucuacucgaccguggccuccagccugguccucguggugucgcugggggccaucuccuucuggaugugcagcaacggcucccugcagugccgcaucugcaucuga

SEQ ID NO: 11332 - RNA, 1701 nt, Artificial Sequence
  derived and/or modified CDS sequence (AUadapt) from InfluenzaA__AHJ57432__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagccccagaucgccauccgcccgaagguccgggaccaggagggccgcaugaacuacuacuggacccugguggagcccggggacaagaucaccuucgaggcgacgggcaaccucguggucccccgguacgccuucgcccuggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcuccggcuggcgacgggccugcgcaacgucccgucgauccagucccggggccucuucggggccaucgccggguucaucgagggcggcuggaccgggaugguggagggcugguacggguaccaccaccagaacgagcagggcagcggguacgccgccgaccugaaguccacccagaacgcgaucgacaagaucaccaacaaggugaacucggucaucgagaagaugaacacgcaguucaccgccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggagaagaucgacggcgugaagcuggagagcacccgcaucuaccagauccuggcgaucuacuccaccgucgccucgucccucgugcugguggucagccugggggccaucucguucuggaugugcuccaacggcagccuccagugccggaucugcaucuga

SEQ ID NO: 11333 - RNA, 1701 nt, Artificial Sequence
  derived and/or modified CDS sequence (AUadapt) from InfluenzaA__AHJ57433__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaaggaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacgugccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 11334 - RNA, 1701 nt, Artificial Sequence
  derived and/or modified CDS sequence (AUadapt) from InfluenzaA__AHJ57434__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacccccuggaggacaagcacaacgggaagcugugcaagcuccgcggcgucgccccgcugcaccuggggaagugcaacaucgccggcuggauccucgggaaccccgagugcgagucgcuguccaccgcgagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggccgaaccacgacucgaacaagggggucaccgccgccugcccccacgccggcgcgaaguccuucuacaagaaccugaucuggcuggugaaggaggggaacucguaccccaagcucuccaagagcuacaucaacgacaagggcaaggaggugcugguccugugggggauccaccaccccucgaccacggccgaccagcagucccucuaccagaacgccgacgccuacguguucgugggcaccucgcgguacuccaagaaguucaagccggagaucgccauccgccccaagguccgggaccaggagggccgcaugaacuacuacuggacccugguggagcccggggacaagaucaccuucgaggcgacgggcaaccugguggucccccgguacgccuucgccauggagcgcaacgccgggagcggcaucaucaucuccgacaccccggugcacgacugcaacacgaccugccagacccccgagggcgccaucaacaccucgcuccccuuccagaacauccaccccaucaccaucgggaagugcccgaaguacgugaaguccaccaagcugcggcuggcgacgggccuccgcaacguccccagcauccagucccgggggcuguucggcgccaucgccggguucaucgagggcggcuggaccgggaugguggacggcugguacggguaccaccaccagaacgagcagggcucgggguacgccgccgaccugaaguccacccagaacgcgaucgacaagaucaccaacaaggugaacucggucaucgagaagaugaacacgcaguucaccgccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgcgaucuacuccaccgucgccucgucccuggugcugguggucagccucggggccaucucguucuggaugugcuccaacggcagccugcagugccggaucugcaucuga

SEQ ID NO: 11335 - RNA, 1701 nt, Artificial Sequence
  derived and/or modified CDS sequence (AUadapt) from InfluenzaA__AHJ57435__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaaccgcggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucgccauggagcggaacgccgggucgggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgucccgucgauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 11336 - RNA, 1701 nt, Artificial Sequence
  derived and/or modified CDS sequence (AUadapt) from InfluenzaA__AHJ57436__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacucguccuucuucagccgccugaacuggcucacgcaccugaacuucaaguaccccgcccugaacgugaccauccccaacaacgagcaguucgacaagcucuacaucuggggcguccaccaccccgggaccgacaaggaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagcugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcguggcccuccugggcuucaucaugugggccugccagaaggggaacauccggugcaacaucugcaucuga

SEQ ID NO: 11337 - RNA, 1701 nt, Artificial Sequence
  derived and/or modified CDS sequence (AUadapt) from InfluenzaA__AHJ57437__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggagcaacuccucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcaguccacccugaagcucgccaccggcaugcgcaacgugcccgagaagcagacgcgggggaucuucggcgcgaucgccggguucaucgagaacggcugggagggcaugguggacgggugguacggcuuccgccaccagaacagcgaggggcggggccaggccgccgaccugaaguccacccaggccgcgaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugaaggagaacgccgaggacauggggaacggcugcuucaagaucuaccacaagugcgacaacgccugcaucggguccauccgcaacggcaccuacgaccacgacgucuaccgcgacgaggcgcucaacaaccgguuccagaucaaggggguggagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11338 - RNA, 1701 nt, Artificial Sequence
  derived and/or modified CDS sequence (AUadapt) from InfluenzaA__AHJ57438__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacuccucguucuucucccgccugaaguggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccgcagcgggaaguccucgaucaugcgguccgacgcccccaucggcaagugcaacucggagugcaucacccccaacggcuccauccccaacgacaagccguuccagaacgugaaccgcaucacguacggggacugcccccgguacgugaagcagagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaccgggucgauccgcaacggcaccuacgaccacgacguguaccgggacgaggcccucaacaaccgcuuccagaucaagggggucgaggugaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 11339 - RNA, 1701 nt, Artificial Sequence
  derived and/or modified CDS sequence (AUadapt) from InfluenzaA__AHJ57651__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacuguacgcuggagggcuggauccucgggaacccgcgcugcggcauccugcuggccgaccagagcugguccuacaucguggagcggcccaacgcccgcaacgggaucugcuaccccggcacccucaacgagguggaggagcugaaggcccugaucggcagcggggagcgggucgagcgcuucgagauguuccccaaguccaccugggccggcguggacaccgacagcgggguguccagcgccugcccgcucggcaaugggcccuccuucuaccggaaccugcuguggaucaucaagcucaagagcuccgaguaccccgucauccgcggcacguucaacaacaccggcgacaagagcauccuguacuucuggggcgugcaccacccgcccgugaccaccgagcaggaggcgcuguacggguccggggaccgguacguccgcaugggcacggagagcaugaauuucgcccggucccccgagaucgccgcccgccccgccgugaacggccagcgggggcgcaucgacuacuucuggagcauccucaagcccggcgagacccugaacguggaguccaacgggaaccugaucgcgccgugguacgccuaccgguucgucaacaaggacagcaagggcgccaucuuccgcagcacccuccccaucgagaacugugacgcgaccugccagacgaccgagggggugauccggaccaacaagaccuuccagaacgugagcccccuguggaucggcgagugccccaaguacgucaaguccaagucccugcgccucgccacgggccugcggaacgugccgcagaucgagacccgcgggcuguucggcgccaucgccggguucaucgagggcggguggaccggcaugaucgacggcugguacggguaccaccacgagaacagccagggcuccggguaugccgccgaccgggagagcacccagaaggccaucgacggcaucacgaacaaggugaacuccaucaucgacaagaugaacacccaguucgaggcggucgggcacgaguucagcaaccucgagcgccgcaucgacaaccugaacaagcggauggaggacggcuuccuggacguguggaccuauaacgccgagcuccuggugcugcucgagaacgagcgcacccuggacaugcacgacgccaacgucaagauccuguacgagaaggugcggucccagcuccgcgacaacgccaaggaccugggcaacgggugcuucgaguucuggcacaagugcgacaacgaguguaucgagagcgucaagaacggcacguacaacuaccccaaguaccaguccgagagccggcugaaccgccagaccaucgaguccgugaagcucgagaaccuggggguguaccagauccuggccaucuacagcaccgucuccagcucccucgugcuggugggccugauccucgcgaugggccuguggaugugcagcaacggguccaugcagugccggaucugcaucuga

SEQ ID NO: 11340 - RNA, 1701 nt, Artificial Sequence
  derived and/or modified CDS sequence (AUadapt) from InfluenzaA__AHJ57663__HA
augaucgccuuuaucgugaucgccacccuggucgcgaccggcaagucggacaagaucugcaucggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagucgugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagagcgggguguccucggccugcccgcucggcaacgggcccuccuucuaucggaaccugcuguggaucaucaagcucaagagcuccgaguaccccgucauccgcggcaccuucaacaacaccggcgacaagucgauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucaagcccggcgagacccugaacguggaguccaacgggaaccugaucgccccgugguacgcguaccgguucgucaacaaggacucgaagggcgccaucuuccgcagcaaccuccccaucgagaacugugacgccacgugccagaccaccgagggggugauccggaccaacaagacguuccagaacgugucgccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacagccagggcuccggguacgccgccgacaaggagagcacgcagaaggccaucgacggcaucaccaacaaggugaacuccaucaucgacaagaugaacacccaguucgaggccgucgggcacgaguucucgaaccucgagcggcgcaucgacaaccugaacaagcgcauggaggacggcuuccuggacguguggaccuauaacgcggagcuccuggugcugcucgagaacgagcggacgcuggaccugcacgacgccaacgucaagaaccuccacgagcgcgugaagucccagcugcgggacaacgccaacgaccugggcaacgggugcuucgaguucuggcacaagugcgacaacgagugcauggagagcgucaagaacggcaccuacaacuaccccaaguaccaggccgagucccgccucaacaagcagaagaucgagucggugaagcuggaggaguucgggguguaccagauccuggccaucuacuccaccgucagcuccagccucgugcuggugggccugaucauggcgaugggccucuggaugugccccaacggguccaugcagugccggaucugcaucuga

SEQ ID NO: 11341 - RNA, 1701 nt, Artificial Sequence
  derived and/or modified CDS sequence (AUadapt) from InfluenzaA__AHJ57674__HA
augaucgccuuuaucgugaucgccauccuggucaccaccggcaagucggacaagaucugcaucggguaccacgcgaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaauccgcgcugcggcauccugcuggccgaccagagcugguccuacaucguggagcggcccaacgcccgcaacgggaucugcuaccccggcacccucaacgaggucgaggagcugaaggcccugaucggcagcggggagcggguggagcgcuucgagauguuccccaaguccaccugggccggcguggacacgaacagcggggucuccucggccugcccgcucggcgaggggcccuccuucuaucggaaccugcuguggaucaucaagcacaccaccagcggcuaccccgugaucaagggcaccuaccgcaacacgggggacaaguccgugcucuacuucuggggcguccaccacccgcccgacaccaccgagcagaacgugcuguacgggagcggcaaccgguacgugcgcaugggcaccgaguccaugaacuuugcccggagccccgagaucgccgcgcgccccgccgucaacgggcagcggggccgcaucgacuacuucugguccauccugaagcccggggagacgcucaacguggagagcaacggcaaccugaucgccccgugguacgccuaccgguucgugaacaaggacuccaagggggccaucuuccgcucgaaccugcccaucgagaacugcgaugcgaccugccagaccaccgagggcgucauccggacgaacaagaccuuccagaacgugagcccccucuggaucggcgagugccccaaguacgugaaguccaagagccugcgccuggccaccgggcuccggaacgucccgcagaucgagacccgcggccuguucggggccaucgccggcuucaucgagggcggguggacgggcaugaucgacgggugguacggcuaccaccacgagaacucccaggggagcggcuaugccgcggaccgggaguccacccagaaggccaucgacgggaucaccaacaaggugaacagcaucaucgacaagaugaacacccaguucgaggccgugggccacgaguucuccaaccuggagcgccgcaucgacaaccucaacaagcggauggaggacggcuuccuggacgucuggacguacaaugccgagcugcucgugcugcuggagaacgagcgcacccucgaccugcacgacgccaacgucaagaaccugcacgagcgggugcgcucgcagcuccgggacaacgcgaacgaccuggggaacggcugcuucgaguucuggcacaagugcgauaacgagugcauggaguccgugaagaacgggaccuacaacuaccccaaguaccaggccgagagccgccugaaccggcagaagaucgaguccgucaagcucgaggaguucggcguguaccagauccuggccaucuacagcaccguguccagcucccugguccucgugggccugaucauggccauggggcuguggaugugcagcaacggcuccaugcagugccgcaucugcaucuga

SEQ ID NO: 11342 - RNA, 1701 nt, Artificial Sequence
  derived and/or modified CDS sequence (AUadapt) from InfluenzaA__AHJ57686__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggagggccgcuucugcaagaucuccaacaaggcgccccucgaccugcgggacugcacgcuggagggguggauccucggcaacccgcgcugcgggauccugcuggccgaccagaguugguccuacaucguggagcggcccaacgcccgcaacggcaucugcuaccccggcauccucaacgaggccgaggagcugaaggcccugaucgggagcggcgagcggguggagcgcuucgagauguuccccaaguccaccugggccggggucgacaccaacagcggcguguccucggcgugcccgcucgggaacggccccuccuucuaccggaaccugcuguggaucaucaagcucaagagcuccgccuaccccgugauccgcggcaccuucaauaacacgggggacaagagcauccuguacuucuggggcguccaccacccgcccguggccaccgagcaggaggcccuguacggguccggcaaccgguacgugcgcaugggcaccgagagcaugaacuucgcccggaaccccgagaucgcggcccgccccgccgucaacgggcagcggggccgcaucgacuacuucugguccauccucaagcccggggagacccugaacguggagagcaacggcaaucugaucgccccgugguacgccuaccgguucgugaacaaggacuccaagggggcgaucuuccgcucgaaccuccccaucgagaacugcgaggccacgugccagaccaccgagggcgucauccggaccaacaagacguuccagaacgugagcccccuguggaucggcgagugccccaaguacgugaaguccaagagccugcgccucgccaccgggcugcggaacgucccgcagaucgagacccgcggccuguucggggccaucgccggcuucaucgagggcggguggaccggcaugaucgaugggugguacggcuaccaccacgagaacucccaggggagcggcuacgcggccgaccgggaguccacgcagaaggccaucgacgggaucaccaacaaggugaacagcaucaucgacaagaugaacacccaguucgaggccgugggccacgaguucuccaaccucgagcgccgcaucgacaaccugaacaagcggauggaggauggcuuccuggacgucuggaccuacaacgccgagcuccuggugcugcucgagaacgagcgcacgcuggaccugcacgacgcgaacgugaagaaccuccacgagaagguccggucgcagcugcgcgacaacgccaacgaccuggggaacggcugcuucgaguucuggcacaagugugacaacgagugcauggaguccgugaagaacgggaccuacgacuaccccaaguaccaggccgagagccggcucaaccgccagaagaucgaguccgucaagcuggagaacuucgacguguaccagauccuggccaucuacagcaccguguccagcucccucguccuggugggccugaucauggcgaugggccucuggaugugcagcaacggguccaugcagugccggaucugcaucuga

SEQ ID NO: 11343 - RNA, 1701 nt, Artificial Sequence
  derived and/or modified CDS sequence (AUadapt) from InfluenzaA__AHJ57697__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcacccucaacgagguggaggagcugaaggcccugaucggcucgggggagcgggucgagcgcuucgagauguuccccaaguccaccugggccggcguggacaccaacagcgggguguccagcgccugcccgcucggcaacgggcccuccuucuaucggaaccugcuguggaucaucaagcucaagucguccgaguaccccgucauccgcggcacguucaacaacaccggcgacaagagcauccuguacuucuggggcgugcaccacccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggucgauccucaagcccggcgagacccugaacguggaguccaacgggaaccugaucgcgccgugguacgccuaccgguucgucaacaaggacagcaagggcgccaucuuccgcagcaaccuccccaucgagaacugcgacgcgaccugucagaccacggagggggugauccggaccaacaagaccuuccagaacgugucgccccuguggaucggcgagugccccaaguacgucaaguccaagucccugcgccucgccaccggccugcggaacgugccgcagaucgagacgcgcgggcuguucggcgccaucgccggguucaucgagggcggguggaccggcaugaucgacggcugguacggguaccaccacgagaacagccagggcuccggguacgccgccgaccgggagagcacccagaaggccaucgacggcaucaccaacaaggugaacuccaucaucgacaagaugaacacgcaguucgaggcggucgggcacgaguucucgaaccucgagcgccgcaucgacaaccugaacaagcggauggaggacggcuuccuggacguguggaccuacaacgccgagcuccuggugcugcucgagaacgagcgcacccuggaucugcacgacgccaacgucaagaaccuccacgagaaggugaagucccagcugcgggacaacgccaacgaccugggcaacgggugcuucgaguucuggcacaagugcgacaacgagugcauggagagcgucaagaacggcaccuacgacuaccccaaguaccaggccgagucccgccucaaccggcagaagaucgagagcgugaagcuggagaacuucgacguguaccagauccuggcgaucuacuccacggucucguccagccucgugcugguggggcugaucauggccaugggccucuggaugugcuccaacggcagcaugcagugccgcaucugcaucuga

SEQ ID NO: 11344 - RNA, 1701 nt, Artificial Sequence
  derived and/or modified CDS sequence (AUadapt) from InfluenzaA__AHJ57707__HA
augaucgccuuuaucgugaucgccauccuggucaccaccggcaagucggacaagaucugcgugggguaccacgcgaacaacuccacgaccaagguggacaccauccucgagaagaacgucaccgugacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucgucgagcggcccaacgcccgcaaugggaucugcuaccccggcacccucaacgagguggaggagcugaaggcccugaucggcucgggggagcggguggagcgcuucgagauguuccccaaguccaccuggacgggcgucgacaccaacagcgggguguccagcgccugcccgcucggcgaggggcccuccuucuaccggaaccugcuguggaucaucaagcacaccaccucgggcuaccccgugaucaagggcacguaccgcaacaccggggacaaguccguccucuacuucuggggcgugcaccacccgcccgacaccaccgagcagaaugugcuguacgggagcggcaaccgguacguccgcaugggcacggaguccaugaacuucgcccggagccccgagaucgccgcccgccccgcggugaacgggcagcggggccgcaucgacuacuucugguccauccugaagcccggggagacccucaacguggagagcaacggcaaccugaucgccccgugguacgccuaccgguucgucaacaaggacuccaagggggccaucuuccgcucgaaccugcccaucgagaacugcgaugcgaccugccagaccacggagggcgugauccggaccaacaagaccuuccagaacgugagcccccucuggaucggcgagugccccaaguacgucaaguccaagagccugcgccuggccaccgggcuccggaacgugccgcagaucgagacgcgcggccuguucggggccaucgccggcuucaucgagggcggguggaccggcaugaucgacgggugguacggcuaccaccacgagaacucccaggggucgggcuacgccgccgaccgggaguccacccagaaggcgaucgacgggaucaccaacaaggugaacagcaucaucgauaagaugaacacgcaguucgaggccgucggccacgaguucuccaaccuggagcgccgcaucgacaaccucaacaagcggauggaggacggcuuccuggacguguggaccuacaacgccgagcugcucguccugcuggagaacgagcgcacccucgaccugcacgacgccaacgugaagaaccugcacgagcgggugcgcagccagcuccgggacaacgccaacgaccuggggaauggcugcuucgaguucuggcacaagugcgacaacgagugcauggaguccgucaagaacgggaccuacaacuaccccaaguaccaggcggagucgcgccugaacaagcagaagaucgaguccgugaagcucgaggaguucggcguguaccagauccuggccaucuacagcacggucuccagcucccuggugcucgugggccugaucauggccauggggcuguggaugugcagcaacggcuccaugcagugccggaucugcaucuga

SEQ ID NO: 11345 - RNA, 1701 nt, Artificial Sequence
  derived and/or modified CDS sequence (AUadapt) from InfluenzaA__AHJ57719__HA
augaucgccuucaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcugucggaccaguccuggagcuacaucguggagcggcccaacgcccgcaacgggaucugcuaccccggcauccucaacgaggccgaggagcugaaggcccugaucggcuccggggagcggguggagcgcuucgagauguuccccaagagcaccugggccggcgucgacaccaacuccggggugucguccgccugcccgcucggcaacgggcccagcuucuuccggaaccugcuguggaucaucaagcucaaguccagcaccuaccccgugauccgcggcacguucaacaacaccggcgacaaguccauccuguacuucuggggcguccaccaccccucggugaccaccgagcaggaggcgcuguacggguccgggaaccgguacgugcgcaugggcacggagagcaugaacuucgcccgguccccggagaucgccgcccgccccgccgucaacggccagcgggggcgcaucgacuacuucuggagcauccucaagcccggcgagacccugaacguggagucgaacgggaaccugaucgcgcccugguacgccuaccgguucgugaacaaggacuccaagggcgccaucuuccgcagcaaccucccgaucgagaacugcgacgcgaccugccagaccaucgagggggucauccggacgaacaagaccuuccagaacgugucgccccuguggaucggcgagugccccaaguacgugaaguccaagucccugcgccucgccaccggccugcggaacgucccccagaucgagacccgcgggcuguucggcgccaucgccggguucaucgagggcggguggacgggcaugaucgacggcugguacggguaccaccacgagaacagccagggcuccggguacgccgacgacaaggagagcacccagaaggccaucgacggcaucaccaacaaggugaacuccaucaucgacaagaugaacacccaguucgaggccguggggcacgaguucucgaaccucgagcggcgcaucgacaaccugaacaagcgcauggaggacggcuuccuggacgucuggacguacaacgcggagcuccuggugcugcucgagaacgagcggacccuggaccugcacgacgccaacgugaagaaccuccacgagaagguccgcucccagcugcgggacaacgccaacgaccugggcaacgggugcuucgaguucuggcacaagugcgacaacgagugcauggagagcgugaagaacggcaccuacgacuacccgaaguaccaggccgagucccgccucaaccggcagaagaucgagagcgucaagcuggagaacuucgacguguaccagauccuggccaucuacuccaccgugucguccagccucguccugguggggcugaucauggcgaugggccucuggaugugcuccaacggcagcaugcagugccgcaucugcaucuga

SEQ ID NO: 11346 - RNA, 1701 nt, Artificial Sequence
  derived and/or modified CDS sequence (AUadapt) from InfluenzaA__AHJ57731__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcucgggggagcggguggagcgcuucgagauguuucccaaguccaccugggccggcgucgacaccgacagcgggguguccagcgcgugcccgcucggcaacgggcccuccuucuaccggaaccugcuguggaucaucaagcucaagagcuccgaguaccccgugauccgcggcaccuucaacaacacgggcgacaagucgauccuguacuucuggggcguccaccacccgcccgugaccaccgagcaggaggcccuguacggguccgggaaccgguacgugcgcaugggcaccgagagcaugaacuucgcccggucccccgagaucgccgcccgccccgcggucaacggccagcgggggcgcaucgacuacuucuggaguauccucaagcccggcgagacgcugaacguggaguccaacgggaaccugaucgccccgugguacgccuaccgguucgugaacaaggacucgaagggcgccaucuuccgcagcaaccuccccaucgagaacugcgacgcgaccugccagaccaccgagggggucauccggacgaacaagaccuuccagaacgugagcccccuguggaucggcgagugccccaaguacgugaaguccaagucccugcgccucgccaccggccugcggaacgucccgcagaucgagacccgcgggcuguucggcgccaucgccggguucaucgagggcggguggacgggcaugaucgacggcugguacggguaccaccacgagaauagccagggcuccggguacgccgccgaccgggagucgacccagaaggcgaucgacggcaucaccaacaaggugaacuccaucaucgacaagaugaacacccaguucgaggccguggggcacgaguucagcaaccucgagcgccgcaucgacaaccugaacaagcggauggaggacggcuuccuggacgucuggacguacaacgccgagcuccuggugcugcucgagaacgagcgcacccuggaccugcacgacgccaacgugaagaaccuccacgagaagguccggucccagcugcgcgacaaugccaacgaccugggcaacgggugcuucgaguucuggcacaagugcgacaacgagugcauggagagcgugaagaacggcaccuacgacuaccccaaguaccagaccgagucccggcucaaccgccagaagaucgagucggucaagcuggagaacuucgacguguaccagauccuggcgaucuacuccacggugagcuccagccucguccugguggggcugaucauggccaugggccucuggaugugcuccaacggcagcaugcagugccggaucugcaucuga

SEQ ID NO: 11347 - RNA, 1701 nt, Artificial Sequence
  derived and/or modified CDS sequence (AUadapt) from InfluenzaA__AHJ57743__HA
augaucgccuucaucgugaucgccauccuggucgcgaccggcaagucggacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgaucgagggcuggauccuggggaacccgcgcugcggcauccuccuggccgaccagucgugguccuacaucguggagcggcccgacgcccgcaacgggaucugcuaccccggcacccugaacgaggccgaggagcucaaggcccugaucggcagcggggagaaggucgagcgguucgagauguuccccaaguccaccugggccggcguggacaccucguccggggugagcuccgccugcccgcugggcaacgggcccucguucuaccgcaaccuccuguggaucaucaagcugaaguccagcgaguaccccgucauccggggcacguucaacaacaccggcgacaaguccgugcucuacuucuggggcgugcaccacccgcccgucaccaccgagcagaacgcgcuguacgggucggggaaccgcuacgugcggaugggcacggaguccaugaacuucgcccgcagccccgagaucgccgcccggcccgccgugaacggccagcgcgggcggaucgacuacuucugguccauccugaagcccggcgagacccucaacgucgagucgaacgggaaccugaucgcgccgugguacgccuaccgcuucgugaacaaggacagcaagggcgccaucuuccgguccaaccugcccaucgagaacugcgacgcgaccugccagaccaucgagggggugauccgcacgaacaagaccuuccagaacgucucgccccucuggaucggcgagugccccaaguacgugaaguccaagagccugcggcuggccaccggccuccgcaacgugccgcagaucgagacccgggggcuguucggcgccaucgccggguucaucgagggcggguggacgggcaugaucgacggcugguacggguaccaccacgagaacucccagggcucgggguacgccgccgaccgcgaguccacccagaaggccaucgacggcaucaccaacaaggucaacagcaucaucgacaagaugaacacccaguucgaggcggccgggcacgaguucuccaaccuggagcggcgcaucgacaaccucaacaagcgcauggaggacggcuuccuggacguguggacguacaacgccgagcugcucgugcugcuggagaacgagcggacccucgaccugcacgacgccaacgucaagaaccugcacgagaaggucaagucgcagcuccgcgacaacgccaacgaccugggcaacgggugcuucgaguucuggcacaagugcgacaacgagugcauggaguccgugaagaacggcaccuacgacuaccccaaguaccagaaggagagccggcugaaccgccagaagaucgaguccgugaagcucgagaacuucgacguguaccagauccuggcgaucuacucgaccgucuccagcucccuggugcucguggggcugaucauggccaugggccuguggaugugcagcaacggcuccaugcagugccggaucugcaucuga

SEQ ID NO: 11348 - RNA, 1701 nt, Artificial Sequence
  derived and/or modified CDS sequence (AUadapt) from InfluenzaA__AHJ57755__HA
augaucgccuucaucgugaucgccauccuggucgcgaccggcaagucggacaagaucugcaucggguaccacgccaacaacuccaccacgaagguggacaccauccucgagaagaacgugaccgucacccacucgguggagcugcuggagaaccagaaggaggagcgcuucugcaagaucuccaacaaggcgccccucgaccugcgggacugcacgaucgagggcuggauccuggggaacccgcgcugcgacauccuccuggccgaccagagcugguccuacaucguggagcggcccaacgcccgcaacggcaucugcuaccccgggacccugaacgaggccgaggagcucaaggcccugaucggcucgggcgagggggucgagcgguucgagauguuccccaaguccaccugggugggcguggacaccagcuccggggucucguccgccugcccgcugggcaacgggcccagcuucuaccgcaaccuccuguggaucaucaagcugaaguccucggaguaccccgugauccggggcacguucaacaacaccggcgacaaguccgugcucuacuucuggggcguccaccacccgcccgugaccaccgagcagaacgcccuguacgggagcgggaaccgcuacgugcggaugggcacggaguccaugaacuucgcgcgcucgcccgagaucgccgcccggcccgccgucaacggccagcgcgggcggaucgacuacuucugguccauccugaagcccggcgagacccucaacguggagagcaacgggaaccugaucgccccgugguacgcguaccgcuucgugaacaaggacaacaagggcgccaucuuccggucgaaccugcccaucgagaacugcgacgcgaccugccagaccacggagggggucauccgcaccaacaagaccuuccagaacgugagcccccucuggaucggcgagugccccaaguacgugaaguccaagucccugcggcuggccaccggccuccgcaacgucccgcagaucgagacgcgggggcuguucggcgccaucgccggguucaucgagggcggguggaccggcaugaucgacggcugguacggguaccaccacgagaacucgcagggcuccggguacgccgccgaccgcgagagcacccagaaggccaucgacggcaucaccaacaaggugaacuccaucaucgacaagaugaacacgcaguucgaggccgcggggcacgaguucucgaaccuggagcggcgcaucgacaaccucaacaagcgcauggaggacggcuuccuggacguguggaccuacaacgccgagcugcucguccugcuggagaacgagcggacccucgaccugcacgacgccaacgugaagaaccugcacgagaaggucaagucccagcuccgcgacaacgccaacgaccugggcaacgggugcuucgaguucuggcacaagugcgacaacgagugcauggagagcgugaagaacggcaccuacgacuaccccaaguaccagaaggagucccggcugaaccgccagaagaucgagucggugaagcucgagaacuucgacgucuaccagauccuggccaucuacuccacggugagcuccucgcugguggucguggggcucaucauggcgaugggccuguggaugugcuccaacggcagcaugcagugccggaucugcaucuga

SEQ ID NO: 11349 - RNA, 1701 nt, Artificial Sequence
  derived and/or modified CDS sequence (AUadapt) from InfluenzaA__AHJ57767__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcacccucaacgagguggaggagcugaaggcccugaucggcucgggggagcgggucgagcgcuucgagauguuccccaaguccaccugggccggcguggacaccaacagcgggguguccagcgccugcccgcucggcaacgggcccuccuucuaccggaaccugcuguggaucaucaagcucaagucguccgaguaccccgucauccgcggcacguucaacaacaccggcgacaagagcauccuguacuucuggggcgugcaccauccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggucgauccucaagcccggcgagacccugaacguggaguccaacgggaaccugaucgcgccgugguacgccuaccgguucgucaacaaggacagcaagggcgccaucuuccgcagcaaccuccccaucgagaacugcgacgcgaccugccagaccacggagggggugauccggaccaacaagaccuuccagaacgugucgccccuguggaucggcgagugccccaaguacgucaaguccaagucccugcgccucgccaccggccugcggaacgugccgcagaucgagacgcgcgggcuguucggcgccaucgccggguucaucgagggcggguggaccggcaugaucgacggcugguacggguaccaccacgagagcucccagggcagcggguacgccgccgacaaggaguccacccagaaggccaucgacggcaucaccaacaaggugaacucgaucaucgacaagaugaacacgcaguuugaggcggucgggcacgaguucuccaaccucgagcggcgcaucgacaaccugaacaagcgcauggaggacggcuuccuggacguguggaccuacaacgccgagcuccuggugcugcucgagaacgagcggacccuggaccugcacgacgccaacgucaagaaccuccacgagaaggugcgcagccagcugcgggacaacgccaacgaccugggcaacgggugcuucgaguucuggcacaagugcaacaacgagugcauggaguccgucaagaacggcaccuacgacuaccccaaguaccagaaggagagccgccucaaccggcagaagaucgaguccgugaagcuggagaacuucgacguguaccagauccuggccaucuacucgacggucuccagcucccucgugcugguggggcugauccucgcgaugggccuguggaugugcagcaacggcuccaugcagugccgcaucugcaucuga

SEQ ID NO: 11350 - RNA, 1701 nt, Artificial Sequence
  derived and/or modified CDS sequence (AUadapt) from InfluenzaA__AHJ57779__HA
augaucgccaucaucaucaucgccauccugguggcgaccggcaagucggacaagaucugcaucggguaccacgccaacaacuccaccacgaaggucgacaccauccucgagaagaacgugaccgugacccacucggucgagcugcuggaggaccagaaggaggagcgcuucugcaagaucuccaacaaggcgccccucgaccugcgggacugcacgaucgagggcuggauccuggggaacccgcgcugcggcauccuccuggccgaccagagcugguccuacaucguggagcggcccaacgcccgcaacgggaucugcuaccccggcacccugaacgaggccgaggagcucaaggcccugaucggcucgggggagggcguggagcgguucgagauguuccccaaguccaccugggccggggucgacaccaacagcggcguguccucggccugcccgcuggggaacggccccuccuucuaccgcaaccuccuguggaucaucaagcugaaguccuccgaguaccccgugauccggggcacguucaacaacaccggggacaagagcguccucuacuucuggggcgugcaccacccgcccgugaccaccgagcagaacgcgcuguacggguccggcaaccgcuacguccggaugggcacggagucgaugaacuucgcccgcucccccgagaucgccgcccggcccgccgugaacgggcagcgcggccggaucgacuacuucuggucgauccugaagcccggggagacccucaacguggaguccaacggcaaccugaucgcgccgugguacgccuaccgcuucgucaacaaggacagcaagggggccaucuuccggucgaaccugcccaucgagaacugcgacgcgaccugccagaccacggagggcgugauccgcaccaacaagaccuuccagaacgugagcccccucuggaucggcgagugccccaaguacgucaagucgaagucccugcggcuggccaccgggcuccgcaacgugccgcagaucgagacgcggggccuguucggggccaucgccggcuucaucgagggcggguggaccggcaugaucgacgggugguacggcuaccaccacgagaacagccagggguccggcuacgccgccgaccgcgagucgacccagaaggccaucgacgggaucaccaacaaggugaacuccaucaucgacaagaugaacacgcaguucgaggcggccggccacgaguucucgaaccuggagcggcgcaucgacaaccucaacaagcgcauggaggacggcuuccuggacgucuggaccuacaacgccgagcugcucgugcugcuggagaacgagcggacccucgaccugcacgacgccaacgugaagaaccugcacgagaaggucaagucccagcuccgcgacaacgccaacgaccuggggaacggcugcuucgaguucuggcacaagugcgacaacgagugcauggagagcgugaagaacgggaccuacgacuaccccaaguaccagaaggagucccggcugaaccgccagaagaucgagucggucaagcucgagaacuucgacguguaccagauccuggcgaucuacuccacggugagcuccucgcugguccucgugggccugaucauggccaugggccuguggaugugcuccaacgggagcaugcagugcaugaucugcaucuga

SEQ ID NO: 11351 - RNA, 1701 nt, Artificial Sequence
  derived and/or modified CDS sequence (AUadapt) from InfluenzaA__AHJ57791__HA
augaucgccaucaucaucaucgccauccuggugaccaccggcaagucggacaagaucugcaucggguaccacgcgaacaacuccacgaccaaggucgacaccauccucgagaagaacgugaccgugacgcacucggucgagcugcuggagaacaagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggugaaggagcugaaggcccugaucggcucgggggagcgggucaagcgcuucgagauguuccccaaguccaccugggccggcguggacacgaacagcgggguguccucguccugcccgcucggcaacgggcccagcuucuaccggaaccugcuguggaucaucaagcacaccaccuccggcuaccccgucaucaagggcaccuacacgaacaccggggacaagucggugcucuacuucuggggcauccaccacccgcccgacaccaccgagcagaacgugcuguacggguccggcaaccgcuacguccggaugggcacggagucgaugaacuucgcccgcucccccgagaucgccgcccggcccgcggugaacgggcagcgcggccggaucgacuacuucuggagcauccugaagcccggggagacccucaacguggaguccaacggcaaccugaucgccccgugguacgccuaccgcuucgucaacaaggacucgaagggggccaucuuccggagcaaccugcccaucgaggacugcgacgcgaccugccagaccacggagggcgugauccgcaccaacaagaccuuccagaacgugucgccccucuggaucggcgagugccccaaguacgucaaguccaagucccugcggcuggccaccgggcuccgcaacgugccgcagaucgagacgcggggccuguucggggccaucgccggcuucaucgagggcggguggaccggcaugaucgacgggugguacggcuaccaccacgagaacagccagggguccggcuacgccgccgaccgcgagucgacccagaaggcgaucgacgggaucaccaacaaggugaacuccaucaucgacaagaugaacacgcaguucgaggccgucggccacgaguucucgaaccuggagcggcgcaucgacacccucaacaagcgcauggaggacggcuuccuggacguguggaccuacaacgccgagcugcucgugcugcuggagaacgagcggacccucgaccugcacgacgccaacgucaagaaccugcacgagcgcgugaagucccagcuccgggacaacgccaacgaccuggggaacggcugcuucgaguucuggcacaagugcgacaacgagugcauggagagcgucaagaacgggacguacaacuaccccaaguaccaggcggagucccgccugaacaagcagaagaucgagucggugaagcucgaggaguucggcguguaccagauccuggccaucuacuccaccgucagcuccucgcuggugcucgugggccugaucauggccaugguccuguggaugugcuccaacgggagcaugcagugccgggugugcaucuga

SEQ ID NO: 11352 - RNA, 1701 nt, Artificial Sequence
  derived and/or modified CDS sequence (AUadapt) from InfluenzaA__AHJ57815__HA
augaucgccuuuaucaucaucaccauccuggugaccacgggcaagucggacaagaucugcaucggguaccacgccaacaacuccaccaccaaggucgacaccauccucgagaagaacgugacggugacccacagcgucgagcugcuggagaaccagaaggaggagcgcuucugccggaucuccaacaaggcgccccucgaccugaaggagugcacccuggagggcuggauccucgggaacccgcagugcgaccugcugcucggcgaccagagcugguccuacaucguggagcgccccaacgcccggaacgggaucugcuaccccggcacccugaacgagguggaggagcugcgcgcccucaucggcagcggggagggcgucgagcgguucgagauguuccccaaguccacgugggccgggguggacaccaaccgcggcgugaccagcuccugcccguucgggagcggcuccagcuuuuaccggaaccugcuguggaucgucaagcacaccacguccagcuaccccgugaucaagggcaccuuccgcaacaccggggacaaguccgugcucuacuucuggggcguccaccaccccuucgacaccaacgagcagaacgugcuguacgggagcggcaaccgguacgugcgcaugggcacggaguccaugaacuucgcccgggggcccgaggucgcggcccgcccgguggugaacggccagcgggggcgcaucgacuacuucuggagcauccugaagcccggcgagacccucaacaucgaguccaacgggaaccugaucgcccccugguacgccuaccgguucgucaacaaggacucgaagggcgcgaucuuccgcagcaaccugcccaucgaggauugcgacgcgaccugccagaccaucgagggcgugauccggacgaacaagaccuuccagaacguguccccgcucuggaucggggagugccccaaguacgucaagagcgagucccugcgccuggccaccggccuccggaacgugccccagaucgagacccgcgggcuguucggcgccaucgccggguucaucgagggcggcuggacggggaugaucgacggcugguacggguaccaccacgagaacagccagggcuccggguacgccgccgaccgggagagcacccagaaggccaucgacggcaucaccaccaaggugaacuccaucaucgacaagaugaacacgcaguucgaggccgucggccacgaguucagcaaccuggagcgccgcaucgacaaccucaacaagcggcuggaggacggguuccuggacguguggaccuacaacgccgagcuccugguccugcucgagaaugagcgcacccuggaccugcacgacgcgaacgugaagaaccuccacgagcgggugcgcucccagcugcgggacaacgccaacgaccugggcaacgggugcuucgaguucuggcacaagugcgacaacgagugcauggagagcgucaagaacggcaccuacaacuaccccaaguaccaggccgagucccgccucaacaagcagcggaucgagagcgugaagcuggagaacuucgacguguaccagauccuggccaucuacuccacggucagcuccagccucgugcuggugggccugauccucgccauggggcuguggaugugcuccaacggcagcaugcagugccgcaucugcaucuga

SEQ ID NO: 11353 - RNA, 1701 nt, Artificial Sequence
  derived and/or modified CDS sequence (AUadapt) from InfluenzaA__AHJ57827__HA
augaucgccuuuaucgugaucgccauccuggucgcgaccggcaagucggacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgaucgagggcuggauccuggggaacccgcgcugcggcauccuccuggccgaccagucgugguccuacaucguggagcggcccaacgcccgcaacgggaucugcuaccccggcacccugaacgaggucgaggagcucaaggcccugaucggcagcggggagcggguggagcgcuucgagauguuccccaaguccaccugggccggcguggacaccaacagcggggucuccucggccugcccgcugggcaacgggcccuccuucuaccggaaccuccuguggaucaucaagaccaagagcuccgaguaccccgugaucaagggcaccuucaacaacaccggcgacaagucggugcuguacuucuggggcguccaccacccgcccucccgcaacgagcagaacgugcucuacgggagcggggaccgguacgugcgcaugggcaccgaguccaugaacuucgcccggagccccgagaucgcggcccgccccgccgucaacggccagcgggggcgcaucgacuacuucugguccauccugaagcccggcgagacgcugaacguggagucgaacgggaaccucaucgccccgugguacgccuaccgguucgugaacaaggacagccgcggcgcgaucuuccgguccaaccugcccaucgagaacugcgaugccacgugccagaccgccgagggggucauccgcaccaacaagacguuccagaacgugagcccccuguggaucggcgagugccccaaguacgugaaguccaagucgcuccggcuggccaccggccugcgcaacgucccgcagaucgagacccggggccucuucggggccaucgcgggguucaucgagggcggguggaccggcaugaucgacggcugguacggguaccaccacgagaacucccagggcagcggguacgccgccgaccgcgaguccacgcagaaggccaucgacggcaucaccaacaaggugaacucgaucaucgacaagaugaacacccaguucgaggccguggggcacgaguucuccaaccuggagcgccggaucgacaaccugaacaagcgcauggaggacggcuuccucgacgucuggaccuacaacgcggagcugcuggugcuccuggagaacgagcggacgcuggaccuccacgacgccaacgucaagaaccugcacgagcgcgucaagagccagcugcgggacaacgccaacgaccucggcaacgggugcuucgaguucuggcacaagugcgacaacgagugcauggaguccgugaagaacggcaccuacgacuaccccaaguaccagaaggagagccgccugaaccggcagaagaucgaguccgugaagcuggagaacuucgacguguaccagauccucgccaucuacucgaccguguccagcucccugguccugguggggcucaucauggccaugggccuguggaugugcagcaacggcuccaugcagugccgcaucugcaucuga

SEQ ID NO: 11354 - RNA, 1701 nt, Artificial Sequence
  derived and/or modified CDS sequence (AUadapt) from InfluenzaA__AHJ57850__HA
augaucgccuuuaucgugaucgccauccuggcgaccaccggcaagucggacaagaucugcaucggguaccacgccaacaacuccacgaccaaggucgacaccauccucgagaagaacgugaccgugacgcacagcgucgagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcucgggggagcggguggagcgcuucgagauguuucccaaguccaccugggccggcgucgacaccgacagcgggguguccagcgccugcccgcucggcaacgggcccuccuucuaccggaaccugcuguggaucaucaagcucaagucguccgaguaccccgugauccgcggcacguucaacaacaccggcgacaagagcauccuguacuucuggggcguccaccacccgcccgugaccaccgagcaggaggcgcuguacggguccgggaaccgguacgugcgcaugggcacggagagcaugaacuucgcccggacccccgagaucgccgcccgccccgccgucaacggccagcgggggcgcaucgacuacuucugguccauccucaagcccggcgagacccugaauguggagagcaacgggaaccugaucgcgccgugguacgccuaccgguucgugaacaaggacuccaagggcgccaucuuccgcucgaaccuccccaucgagaacugcgacgcgaccugccagacgaccgagggggucauccggaccaacaagaccuuccagaacgugagcccccuguggaucggcgagugccccaaguacgugaaguccaagagccugcgccucgccacgggccugcggaacgucccgcagaucgagacccgcgggcuguucggcgccaucgccggguucaucgagggcggguggaccggcaugaucgacggcugguacggguaccaccacgagaauucccagggcucgggguacgccgccgaccgggaguccacccagaaggccaucgacggcaucacgaacaaggugaacagcaucaucgacaagaugaacacccaguucgaggcgguggggcacgaguucuccaaccucgagcgccgcaucgacaaccugaacaagcggauggaggacggcuuccuggacgucuggaccuacaacgccgagcuccuggugcugcucgagaacgagcgcacccuggaccugcacgacgccaacgugaagaaccuccacgagaagguccggagccagcugcgcgacaaugccaacgaccugggcaacgggugcuucgaguucuggcacaagugcgacaacgagugcauggaguccgugaagaacggcacguacgacuaccccaaguaccaggccgagucgcggcucaaccgccagaagaucgaguccgucaagcuggagaacuucgacguguaccagauccuggcgaucuacagcaccguguccagcucccucguccugguggggcugaucauggccaugggccucuggaugugcagcaacggcuccaugcagugccggaucugcaucuga

SEQ ID NO: 11355 - RNA, 1701 nt, Artificial Sequence
  derived and/or modified CDS sequence (AUadapt) from InfluenzaA__AHJ57862__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcucgggggagcggguggagcgcuucgagauguuucccaaguccaccugggccggcgucgacaccaacagcgggguguccagcgcgugcccgcucggcaacgggcccuccuucuaccggaaccugcuguggaucaucaagcucaagagcuccgaguaccccgugauccgcggcaccuucaacaacacgggcgacaagucgauccuguacuucuggggcguccaccacccgcccgugaccaccgagcaggaggcccuguacggguccgggaaccgguacgugcgcaugggcaccgagagcaugaacuucgcccggucccccgagaucgccgcccgccccgcggucaacggccagcgggggcgcaucgacuacuucuggaguauccucaagcccggcgagacgcugaacguggaguccaacgggaaccugaucgccccgugguacgccuaccgguucgugaacaaggacucgaagggcgccaucuuccgcagcaaccuccccaucgagaacugcgacgcgaccugccagaccaccgagggggucauccggacgaacaagaccuuccagaacgugagcccccuguggaucggcgagugccccaaguacgugaaguccaagucccugcgccucgccaccggccugcggaacgucccgcagaucgagacccgcgggcuguucggcgccaucgccggguucaucgagggcggguggacgggcaugaucgacggcugguacggguaccaccacgagaauagccagggcuccggguacgccgccgaccgggagucgacccagaaggcgaucgacggcaucaccaacaaggugaacuccaucaucgacaagaugaacacccaguucgaggccguggggcacgaguucagcaaccucgagcgccgcaucgacaaccugaacaagcggauggaggacggcuuccuggacgucuggacguacaacgccgagcuccuggugcugcucgagaacgagcgcacccuggaccugcacgacgccaacgugaagaaccuccacgagaagguccggucccagcugcgcgacaaugccaacgaccugggcaacgggugcuucgaguucuggcacaagugcgacaacgagugcauggagagcgugaagaacggcaccuacgacuaccccaaguaccaggcggagucccggcucaaccgccagaagaucgagucggucaagcuggagaacuucgacguguaccagauccuggccaucuacuccaccgugagcuccagccucguccugguggggcugaucauggccaugggccucuggaugugcuccaacggcagcaugcagugccggaucugcaucuga

SEQ ID NO: 11356 - RNA, 1701 nt, Artificial Sequence
  derived and/or modified CDS sequence (AUadapt) from InfluenzaA__AHJ57873__HA
augaucgccuuuaucgugaucgccacccuggucgcgaccggcaagucggacaagaucugcaugggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagucgugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagagcgggguguccucggccugcccgcucggcaacgggcccuccuucuaccggaaucugcuguggaucaucaagcucaagagcuccgaguaccccgucauccgcggcaccuucaacaacaccggcgacaagucgauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggagcauccucacccccggcgagacgcugaacguggaguccaacgggaaccugaucgccccgugguacgcguaccgguucgucaacaaggacucgaagggcgccaucuuccgcagcaaccuccccaucgagaacugcgacgcgaccugucagaccaccgagggggugauccggacgaacaagaccuuccagaacgugagcccccuguggaucggcgagugccccaaguacgucaaguccaagucccugcgccucgccaccggccugcggaacgugccgcagaucgagacccgcgggcuguucggcgccaucgccggguucaucgagggcggguggacgggcaugaucgacggcugguacggguaccaccacgagaacucgcagggcuccggguacgccgccgacaaggagagcacccagaaggccaucgacggcaucaccaacaaggugaacuccaucaucgacaagaugaacacccaguucgaggccgucgggcacgaguucucgaaccucgagcggcgcaucgacaaccugaacaagcgcauggaggacggcuuccuggacguguggacguacaacgcggagcuccuggugcugcucgagaacgagcggacccuggaucugcacgacgccaacgucaagaaccuccacgagaaggugcgcucccagcugcgggacaacgccaacgaccugggcaacgggugcuucgaguucuggcacaagugcgacaacgagugcauggagagcgucaagaacggcaccuacgacuaccccaaguaccagaaggagucccgccucaaccggcagaagaucgagagcgugaagcuggagaacuucgacguguaccagauccuggccaucuacuccaccgucucguccagccucgugcugguggggcugauccucgccaugggccuguggaugugcuccaacggcagcaugcacugccgcaucugcaucuga

SEQ ID NO: 11357 - RNA, 1701 nt, Artificial Sequence
  derived and/or modified CDS sequence (AUadapt) from InfluenzaA__AHJ57885__HA
augaucgccuuuaucgugauggccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaauccgcgcugcggcauccugcuggccgaccagagcugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacagcgggguguccucggcgugcccgcucggcaacgggcccuccuucuaucggaaccugcuguggaucaucaagcgcaagagcuccgccuaccccgugauccggggcaccuucaacaacacgggcgacaagagcauccucuacuucuggggcguccaccacccgcccgugaccaccgagcaggaggcccuguacggguccgggaaccgcuacgugcggaugggcaccgagagcaugaacuucgcccgcaaucccgagaucgccgcgcggcccgccgucaacggccagcgcgggcggaucgacuacuucugguccauccugaagcccggcgagacgcucaacaucgagagcaacgggaaccugaucgccccgugguacgccuaccgcuucgugaacaaggacuccaagggcgccaucuuccggucgaaccugcccaucgaggacugcgacgcgaguugccagaccaccgagggggugauccgcaccaacaagacguuccagaacgucagcccccucuggaucggcgagugccccaaguacgugaaguccaagucccugcggcuggccaccggccuccgcaacgugccgcagaucgagacccgggggcuguucggcgccaucgccggguucaucgagggcggguggaccggcaugaucgacggcugguacggguaccaccacgagaacagccagggcuccggguacgccgcggaccgcgagaguacgcagaaggccaucgacggcaucaccaacaaggucaacuccaucaucgacaagaugaacacccaguucgaggccguggggcacgaguucucgaaccuggagcgccggaucgacaaccucgacaagcgcauggaggacggcuuccuggacguguggaccuacaacgccgagcugcucguccugcuggagaaugagcggacgcucgaccugcacgacgccaacgugaagaaccugcacgagaaggugcgcucccagcuccgggacaacgcgaacgaccugggcaacgggugcuucgaguucuggcacaagugcgacaacgagugcauggagagugucaagaacggcaccuacgacuaccccaaguaccaggccgagucccgccugaaccggcagaagaucgagagcgugaagcucgagaacuucgacgucuaccagauccuggccaucuacuccaccgugagcuccagccuggugcucgucgggcugaucauggccaugggccuguggaugugcuccaacggcagcaugcagugccgcaucugcaucuga

SEQ ID NO: 11358 - RNA, 1701 nt, Artificial Sequence
  derived and/or modified CDS sequence (AUadapt) from InfluenzaA__AHJ57897__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagaguugguccuacaucguggagcggcccaacgcccgcaacgggaucugcuaccccggcauccucaacgaggccgaggagcugaaggcccugaucggcagcggggagcggguggagcgcuucgagauguuccccaaguccaccugggccggcgucgacaccgacucggggguguccagcgcgugcccgcucggcaacgggcccuccuucuaccggaaccugcuguggaucaucaagcgcaagagcuccgccuaccccgugauccggggcaccuucaauaacacgggcgacaagagcauccucuacuucuggggcguccaccacccgcccgugaccaccgagcaggaggcccuguacggguccgggaaccgcuacgugcggaugggcaccgagucgaugaacuucgcccgcaaccccgagaucgccgcgcggcccgccgucaacggccagcgcgggcggaucgacuacuucugguccauccugaagcccggcgagacgcucaacaucgagagcaacgggaaccugaucgccccgugguaugccuaccgcuucgugaacaaggacuccaagggcgccaucuuccggagcaaccugcccaucgaggacugcgacgcgagcugccagaccaccgagggggugauccgcaccaacaagacguuccagaacgucucgccccucuggaucggcgagugccccaaguacgugaaguccaagucccugcggcuggccaccggccuccgcaacgugccgcagaucgagacccgggggcuguucggcgccaucgccggguucaucgagggcggguggaccggcaugaucgauggcugguacggguaccaccacgagaacagccagggcuccggguacgccgcggaccgcgagagcacgcagaaggccaucgacggcaucaccaacaaggucaacuccaucaucgacaagaugaacacccaguucgaggccguggggcacgaguucagcaaccuggagcgccggaucgacaaccucaacaagcgcauggaggauggcuuccuggacguguggaccuacaacgccgagcugcucguccugcuggagaacgagcggacgcucgaccugcacgacgccaacgugaagaaccugcacgagaaggugcgcucccagcuccgggacaacgcgaacgaccugggcaacgggugcuucgaguucuggcacaagugcgauaacgagugcauggagucggucaagaacggcaccuacgacuaccccaaguaccaggccgagucccgccugaaccggcagaagaucgagagcgugaagcucgagaacuucgacgucuaccagauccuggccaucuacuccaccgugagcuccagccuggugcucgucgggcugaucauggccaugggccuguggaugugcuccaacggcagcaugcagugccgcaucugcaucuga

SEQ ID NO: 11359 - RNA, 1701 nt, Artificial Sequence
  derived and/or modified CDS sequence (AUadapt) from InfluenzaA__AHJ57908__HA
augaucgccuuuaucgugaucgccauccuggucgcgaccggcaagucggacaagaucugcaucggguaccacgccaacaacuccaccacgaagguggacaccauccucgagaagaacgugaccgucacccacagcguggagcugcuggagaaccagaaggaggagcgcuucugcaagaucuccaacaaggcgccccucgaccugcgggacugcacgguggagggcuggauccuggggaacccgcgcugcggcauccucaucgccgaccagucgugguccuacaucgucgagcggcccaacgcccgcaacgggaucugcuaccccggcacccugaacgaggccgaggagcugaaggcccucaucggcagcggggagggcguggagcgguucgagauguuccccaaguccaccugggccgggguggacaccagcuccggcgucucguccgccugcccgcuggggaacggccccagcuucuaccgcaaccugcucuggaucaucaagcugaaguccucggaguaccccgugauccggggcacguucaacaacaccggggacaaguccgugcuguacuucuggggcguccaccacccgcccgugaccaccgagcaggacgcgcucuaugggagcggcaaccgcuacgugcggaugggcacggaguccaugaacuucgcccgcagccccgagaucgccgcccggcccgccgucaacgggcagcgcggccggaucgacuacuucugguccgugcugaagcccggggagacccugaacguggagucgaacggcaaccucaucgcgccgugguacgccuaccgcuucgucaacaaggacaacaagggggccaucuuccggagcaaccugcccaucgagaacugcgacgcgaccugccagaccacggagggcgugauccgcaccaacaagaccuuccagaacgugagcccccuguggaucggcgagugccccaaguacgucaaguccaagucccuccggcuggccaccgggcugcgcaacgugccgcagaucgagacgcggggccucuucggggccaucgccggcuucaucgagggcggguggaccggcaugaucgacgggugguacggcuaccaccacgagaacucgcagggguccggcuacgccgccgaccgcgagagcacccagaaggccaucgacgggaucaccaacaaggugaacuccaucaucgacaagaugaacacgcaguuugaggcggccggccacgaguucucgaaccuggagcggcgcaucgacaaccugaacaagcgcauggaggacggcuuccucgacgucuggaccuacaacgccgagcugcuggugcuccuggagaacgagcggacccuggaccuccacgacgccaacgucaagaaccugcacgagaaggugaagucccagcugcgcgacaacgccaacgaccucgggaacggcugcuucgaguucuggcacaagugcgacaacgagugcauggagagcgugaagaacgggaccuacgacuaccccaaguaccagaaggagucccggcugaaccgccagcggaucgagagcgucaagcuggagaacuucgacguguaccagauccucgcgaucuacuccacggugucguccagccuggucguggugggccugaucauggccaugggccucuggaugugcuccaacgggagcaugcagugcaugaucugcaucuga

SEQ ID NO: 11360 - RNA, 1701 nt, Artificial Sequence
  derived and/or modified CDS sequence (AUadapt) from InfluenzaA__AHJ57920__HA
augaucgccaucaucaucaucgccauccugguggcgaccggcaagagugacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgaucgagggcuggauccuggggaacccguggugcggcauccuccuggccgaccagucgugguccuacaucguggagcgccccaacgcccggaacgggaucugcuaccccggcacccugaacgagguggaggagcucaaggcccugaucggcagcggggagcgcgucgagcgguucgagauguuccccaaguccaccugggccggcguggacaccaacucggggguguccagcgccugcccgcugggcaacgggcccuccuucuaccgcaaccuccuguggaucaucaagaccaagagcuccgaguaccccgucaucaagggcaccuucaacaacaccggcgacaagucggugcuguacuucuggggcgugcaccacccgcccucccggaacgagcagaacguccucuacgggagcggggaccgcuacgugcggaugggcaccgaguccaugaacuucgcccgcucgcccgagaucgcggcccggcccgccgugaacggccagcgcgggcggaucgacuacuucugguccauccugaagcccggcgagacgcugaacgucgagagcaacgggaaccucaucgccccgugguacgccuaccgcuucgugaacaaggacucgcggggcgcgaucuuccgcuccaaccugcccaucgagaacugcgacgccacgugucagaccgccgagggggugauccggaccaacaagacguuccagaacgucagcccccuguggaucggcgagugccccaaguacgugaaguccaagagccuccgccuggccaccggccugcggaacgugccgcagaucgagacccgcggccucuucggggccaucgcgggguucaucgagggcggguggaccggcaugaucgacggcugguacggguaccaccacgagaacucccagggcucgggguacgccgccgaccgggaguccacgcagaaggccaccgacggcaucaccaacaaggucaacagcaucaucgacaagaugaacacccaguucgaggccguggggcacgaguucuccaaccuggagcgccgcaucgacaaccugaacaagcggauggaggacggcuuccucgacguguggacguacaacgcggagcugcugguccuccuggagaacgagcgcacccuggaccuccacgacgccaacgugaagaaccugcacgagcgggucaagucgcagcugcgcgacaacgccaacgaccucggcaacgggugcuucgaguucuggcacaagugcgacaacgagugcauggaguccgugaagaacgacaccuacgacuaccccaaguaccagaaggagagccggcugaaccgccagaagaucgaguccgugcggcuggagaacuucgacgucuaccagauccucgccaucuacucgaccguguccagcucccuggugcuggucggccucaucauggccauggggcuguggaugugcagcaacggcuccaugcagugccgcaucugcaucuga

SEQ ID NO: 11361 - RNA, 1701 nt, Artificial Sequence
  derived and/or modified CDS sequence (AUadapt) from InfluenzaA__AHJ57932__HA
augaucgcccugaucaucaucaccauccucgugaccacgggcaagagugacaagaucugcaucggguaccacgccaacaacuccaccaccaaggucgacaccauccuggagaagaacgugacggugacccacagcgucgagcugcucgagaaccagaaggaggagcgcuucugccggaucuccaacaaggcgccccuggaccugaaggagugcacccucgagggcuggauccuggggaacccgcagugcgaccugcuccugggcgaccagagcugguccuauaucguggagcgccccaacgcccggaacgggaucugcuaccccggcacccugaacgagguggaggagcuccgcgcccugaucggcagcggggagggcgucgagcgguucgagauguuccccaaguccacgugggccgggguggacaccaaccgcggcgugaccagcuccugcccguucgggagcggcuccagcuucuaccggaaccugcucuggaucgucaagcacaccacguccagcuaccccgugaucaagggcaccuuccgcaauaccggggacaaguccgugcuguacuucuggggcguccaccaccccuucgacaccaacgagcagaacgugcuguacgggagcggcaaccgguacgugcgcaugggcacggaguccaugaacuucgcccgggggcccgaggucgcggcccgcccgguggugaacggccagcgggggcgcaucgacuacuucuggagcauccucaagcccggcgagacccugaacaucgaguccaaugggaaccugaucgcccccugguacgccuaccgguucgucaacaaggacagcaagggcgcgaucuuccgcagcaaccuccccaucgaggacugcgacgcgaccugccagaccaucgagggcgugauccggacgaacaagaccuuccagaacguguccccgcuguggaucggggagugccccaaguacgucaagagcgagucccugcgccucgccaccggccugcggaacgugccccagaucgagacccgcgggcuguucggcgccaucgccggguuuaucgagggcggcuggacggggaugaucgacggcugguacggguaccaccacgagaacagccagggcuccggguacgccgccgaccgggagagcacccagaaggccaucgacggcaucaccaccaaggugaacuccaucaucgacaagaugaacacgcaguucgaggccgucggccacgaguucagcaaccucgagcgccgcaucgacaaccugaauaagcggcuggaggacggguuccucgacguguggaccuacaacgccgagcugcugguccuccuggagaacgagcgcacccuggaccuccacgacgcgaacgugaagaaccugcacgagcgggugcgcucccagcugcgggacaacgccaacgaccucggcaacgggugcuucgaguucuggcacaagugcgauaacgagugcauggagagcguccgcaacggcaccuacaacuaccccaaguaccaggccgagucccggcugaacaagcagcgcaucgagagcgugaagcuggagaacuucgacguguaccagauccucgccaucuacuccacggucagcuccagccuggugcuggugggccucauccuggccauggggcuguggaugugcuccaacggcagcaugcagugccggaucugcaucuga

SEQ ID NO: 11362 - RNA, 1701 nt, Artificial Sequence
  derived and/or modified CDS sequence (AUadapt) from InfluenzaA__AHJ57943__HA
augaucgccuuuaucgugaucgccacccuggucgcgaccggcaagucggacaagaucugcaucggguaccacgccaacaacuccacgaccaagguggacaccauccucgagaagaacgugaccgucacgcacucgguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcucgggggagcgggucgagcgcuucgagauguuccccaaguccaccuggacgggcguggacaccgagagcgggguguccucggccugcccgcucggcaacgggcccuccuucuaccggaaccugcuguggaucaucaagcucaagagcuccgaguaccccgucauccgcggcaccuucaacaacaccggcgacaagucgauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggucgauccucaagcccggcgagacccugaacguggaguccaacgggaaccugaucgccccgugguacgcguaccgguucgucaacaaggacagcaagggcgccaucuuccgcucgaaccuccccaucgagaacugcgacgccacgugccagaccaccgagggggugauccggaccaacaagacguuccagaacgugagcccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacucgcagggcuccggguacgccgccgacaaggagagcacgcagaaggccaucgacggcaucaccaacaaggugaacuccaucaucgacaagaugaacacccaguucgagaccgucgggcacgaguucucgaaccucgagcggcgcaucgacaaccugaacaagcgcauggaggacggcuuccuggacguguggacguacaacgccgagcuccuggugcugcucgagaacgagcggacccuggaccugcacgacgcgaacgucaagaaccuccacgagaaggugcgcucccagcugcgggacaacgccaacgaccugggcaacgggugcuucgaguucuggcacaagugcaacaacgagugcauggagagcgucaagaacggcaccuacgacuaccccaaguaccagaaggagucccgccucaaccggcagaagaucgagucggugaagcuggagaacuucgacguguaccagauccuggccaucuacuccaccgucagcuccucgcucgugcugguggggcugauccucgccaugggccuguggaugugcuccaacggcagcaugcagugccgcaucugcaucuga

SEQ ID NO: 11363 - RNA, 1701 nt, Artificial Sequence
  derived and/or modified CDS sequence (AUadapt) from InfluenzaA__AHJ57954__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagucgugguccuacaucguggagcggcccaacgcccgcaacgggaucugcuaccccggcauccucaacgaggccgaggagcugaaggcccugaucggcagcggggagcggguggagcgcuucgagauguuucccaaguccaccugggccggcgucgacaccaacagcgggguguccucggcgugcccgcucggcaacgggcccuccuucuaccggaaccugcuguggaucaucaagcagaaguccagcgccuaccccgugauccgcggcaccuucaacaacacgggcgacaagagcauccucuacuucuggggcguccaccacccgcccgugaccaccgagcaggaggcccuguacggguccgggaaccgguacgugcgcaugggcaccgagucgaugaacuucgcccggaaccccgagaucgccgcgcgccccgccgucaacggccagcgggggcgcaucgacuacuuuugguccauccugaagcccggcgagacgcucaacguggagagcaacgggaaccugaucgccccgugguacgccuaccgguucgugaacaaggacuccaagggcgccaucuuccgcagcaaccugcccaucgagaacugcgacgcgaccugccagaccaccgagggggucauccggacgaacaagaccuuccagaacgugucgccccucuggaucggcgagugccccaaguacgugaaguccaagagccugcgccuggccaccggccuccggaacgucccgcagaucgagacccgcgggcuguucggcgccaucgccggguucaucgagggcggguggacgggcaugaucgacggcugguacggguaccaccaugagaacucccagggcagcggguacgccgcggaccgggaguccacccagaaggccaucgacggcaucaccaacaaggugaacucgaucaucgacaagaugaacacccaguucgaggccguggggcacgaguucuccaaccuggagcgccgcaucgacaaccucaacaagcggauggaggacggcuuccuggacgucuggacguacaacgccgagcugcucgugcugcuggagaacgagcgcacccucgaccugcacgacgccaacgugaagaaccugcacgagaagguccggagccagcuccgcgauaacgcgaacgaccugggcaacgggugcuucgaguucuggcacaagugcgacaacgagugcauggaguccgugaagaacggcaccuacgacuaccccaaguaccaggccgagagccggcugaaccgccagaagaucgaguccgucaagcucgagaacuucgacguguaccagauccuggccaucuacucgaccguguccagcucccugguccucguggggcugaucauggccaugggccuguggaugugcagcaacggcuccaugcagugccggaucugcaucuga

SEQ ID NO: 11364 - RNA, 1701 nt, Artificial Sequence
  derived and/or modified CDS sequence (AUadapt) from InfluenzaA__AHJ57965__HA
augaucgccuucaucaucaucaccauccuggugaccacgggcaagucggacaagaucugcaucggguaccacgccaacaacuccaccaccaaggucgacaccauccucgagaagaacgugacggugacccacagcgucgagcugcuggagaaccagaaggaggagcgcuucugcaagaucuccaacaaggcgccccucgaccugaaggagugcacccuggagggcuggauccucgggaacccgcagugcgaccugcugcucggcgaccagagcugguccuacaucguggagcggcccaacgcccgcaacgggaucugcuaccccggcacccugaacgagguggaggagcugaaggcccucaucggcucgggggagcgggucgagcgcuucgagauguuccccaaguccacgugggccggcguggacaccaacagcggggugaccuccagcugcuccuucggcucgggguccagcuucuaccggaaccugcuguggaucaucaagcacaccacguccagcuacccggucaucaagggcaccuuccgcaacaccggcgacaaguccgugcucuacuucuggggcgugcaccaccccaucgacaccacggagcagaacguccuguacgggucggggaaccgguacgugcgcaugggcaccgaguccaugaacuucgcccggagccccgagaucgcggcccgccccguggucaacggccagcgggggcgcaucgacuacuucuggagcauccugaagccgggcgagacccucaacaucgaguccaacgggaaccugaucgcccccugguacgccuaccgguucgugaacaaggacagcaagggcgcgaucuuccgcuccaaccugcccaucgagaacugcgacgcgaccugccagacgaucgagggggugauccggaccaacaagaccuuccagaacgucucgccccucuggaucggcgagugcccgaaguacgugaaguccgagagccugcgccuggccaccggccuccggaacgugccccagaucgagacgcgcgggcuguucggcgccaucgccggguucaucgagggcggguggaccggcaugaucgacggcugguacggguaccaccacgagaacucccagggcagcggguacgccgccgaccgggaguccacccagcgcgccaucgacggcaucaccacgaaggucaacucgaucaucgacaagaugaacacccaguucgaggccguggggcacgaguucuccaaccuggagcggcgcaucgacaaccucaacaagcgcauggaggacggcuuccuggacguguggaccuacaacgccgagcugcucguccugcuggagaacgagcggacccucgaccugcacgacgcgaacgugaagaaccugcacgagcgcguccggagccagcuccgcgacaacgccaacgacggcgggaacggcugcuucgaguucuggcacaagugcgacaacgagugcauggaguccgugaagaacgggacguacgacuaccccaaguaccaggccgagagccgguccaaccgccagcggaucgagucggugaagcuggagaacuucgacgucuaccagauccuggccaucuacuccaccgugagcuccagccucguggucguguggcugauccuggccaugggccucuggaugugcgcgaacggcagcaugcagugccgcaucugcaucuga

SEQ ID NO: 11365 - RNA, 1701 nt, Artificial Sequence
  derived and/or modified CDS sequence (AUadapt) from InfluenzaA__AHJ57977__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgaucgagggcuggauccuggggaacccgcgcugcggcauccuccuggccgaccagucgugguccuacaucguggagcggcccaacgcccgcaacgggaucugcuaccccggcacccugaacgagguggaggagcucaaggcccugaucggcagcggggagcgggucgagcgcuucgagauguuccccaaguccaccugggccggcguggacaccaacucggggguguccagcgccugcccgcugggcaacgggcccuccuucuaccggaaccuccuguggaucaucaagcugaaguccuccgaguaccccgucauccgcggcacguucaacaacaccggcgacaagucgauccucuacuucuggggcgugcaccacccgcccgugaccaccgagcaggaggcgcuguacggguccggggaccgguacguccgcaugggcacggagagcaugaacuucgcccggucccccgagaucgccgcccgccccgccgugaacggccagcgggggcgcaucgacuacuucuggucgauccugaagcccggcgagacccucaacguggaguccaacgggaaccugaucgcgccgugguacgccuaccgguucgucaacaaggacagcaagggcgccaucuuccgcucgaaccugcccaucgagaacugcgacgcgaccugccagaccacggagggggugauccggaccaacaagaccuuccagaacgugagcccccucuggaucggcgagugccccaaguacgucaagucgaagucccugcgccuggccaccggccuccggaacgugccgcagaucgagacgcgcgggcuguucggcgccaucgccggguucaucgagggcggguggaccggcaugaucgacggcugguacggguaccaccacgagaacagccagggcuccggguacgccgccgacaaggagucgacccagaaggccaucgacggcaucaccaacaaggugaacuccaucaucgacaagaugaacacgcaguucgaggcggucgggcacgaguucagcaaccuggagcggcgcaucgacaaccucaacaagcgcauggaggacggcuuccuggacguguggaccuacaacgccgagcugcucgugcugcuggagaacgagcggacccucgaccugcacgacgccaacgucaagaaccugcacgagaaggugcgcucccagcuccgggacaacgccaacgaccugggcaacgggugcuucgaguucuggcacaagugcaacaacgagugcauggagucggucaagaacggcaccuacgacuaccccaaguaccagaaggagucccgccugaaccggcagaagaucgagagcgugaagcucgagaacuucgacguguaccagauccuggccaucuacuccacggucucguccagccuggugcucguggggcugauccuggcgaugggccucuggaugugcuccaacggcagcaugcagugccgcaucugcaucuga

SEQ ID NO: 11366 - RNA, 1701 nt, Artificial Sequence
  derived and/or modified CDS sequence (AUadapt) from InfluenzaA__AHJ57989__HA
augaucgccuuuaucgugaucgccauccuggucaccaccggcaagucggacaagaucugcaucggguaccacgcgaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagucgugguccuacaucguggagcggcccaacgcccgcaacgggaucugcuaccccggcacccucaacgaggucgaggagcugaaggcccugaucggcagcggggagcggguggagcgcuucgagauguuccccaaguccaccugggcccggguggacacggaccgcggcgucagcuccgccugcccgcucgggaacggccccucguuuuaccggaaccugcuguggaucgugaagcacaccaccuccgaguaccccgugaucaaggggaccuacacgaacaccggcgacaagagcguccucuacuucuggggcgugcaccacccgcccgacaccaccgagcagaacgugcuguacggguccggcaaccgcuacguccggauggggacggagucgaugaacuucgcccgcucccccgagaucgccgcgcggcccgccgugaacggccagcgcggccggaucgacuacuucuggagcauccugaagcccggggagacccucaacguggaguccaacggcaaccugaucgccccgugguacgccuaccgcuucgucaacaaggacagcaagggggccaucuuccgguccaaccugcccaucgagaacugcgaugcgaccugccagaccacggagggcgugauccgcaccaacaagaccuuccagaacgugucgcccauguggaucggggagugccccaaguacgucaagagcaagucccuccggcuggccaccggccugcgcaacgugccgcagaucgagacgcggggccucuucggggccaucgccggcuucaucgagggcggguggaccgggaugaucgacggcugguacggcuaccaccacgagaacucgcagggguccggcuacgccgcggaccgcgagagcacccagaaggccaucgacgggaucaccaacaaggugaacuccaucaucgacaagaugaacacgcaguucgaggccgucggccacgaguucagcaaccuggagcgccggaucgacaaccugaacaagcgcauggaggacggguuccucgacguguggaccuacaaugccgagcugcugguccuccuggagaacgagcggacccuggaccuccacgacuccaacgugaagaaccugcacgagcgcgucaagucgcagcugcgggacaacgccaacgaccucggcaacggcugcuucgaguucuggcacaagugcgacaacgagugcauggaguccgugaagaacgggaccuacaacuaccccaaguaccaggcggagagccgccugaaccggcagaagaucgaguccgugaagcuggaggaguucggcguguaccagauccucgccaucuacucgacggucuccagcucccuggugcugguggggcucaucauggccaugggccuguggaugugcagcaacggcuccaugcagugccgcaucugcaucuga

SEQ ID NO: 11367 - RNA, 1701 nt, Artificial Sequence
  derived and/or modified CDS sequence (AUadapt) from InfluenzaA__AHJ58001__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaacgggaucugcuaccccggcauccucaacgaggccgaggagcugaaggcccugaucggcucgggggagcggguggagcgcuucgagauguuccccaaguccaccugggccggcgucgacaccgacagcgggguguccagcgcgugcccgcucggcaacgggcccuccuucuaucggaaccugcuguggaucaucaagcucaagucguccgaguaccccgugauccgcggcaccuucaacaacacgggcgacaagagcauccuguacuucuggggcguccaccacccgcccgugaccaccgagcaggaggcccuguacggguccgggaaccgguacgugcgcaugggcaccgagagcaugaacuucgcccggucccccgagaucgccgcccgccccgcggucaacggccagcgggggcgcaucgacuacuucuggucgauccucaagcccggcgagacgcugaacguggaguccaacgggaaccugaucgccccgugguacgccuaccgguucgugaacaaggacagcaagggcgccaucuuccgcagcaaccuccccaucgagaacugcgacgcgaccugucagaccaccgagggggucauccggacgaacaagaccuuccagaacgugucccccauguggaucggcgagugccccaaguacgucaagucgaagucccugcgccuggccaccggccuccggaacgugccgcagaucgagacccgcgggcuguucggcgccaucgccggguucaucgagggcggguggacgggcaugaucgacggcugguacggguaccaccacgagaacagccagggcuccggguacgccgccgaccgggagagcacccagaaggcgaucgacggcaucaccaacaaggugaacuccaucaucgacaagaugaacacccaguucgaggccguggggcacgaguucucgaaccuggagcgccgcaucgacaaccucaacaagcggauggaggacggcuuccuggacgucuggacguacaacgccgagcugcucgugcugcuggagaacgagcgcacccucgaucugcacgacgccaacgugaagaaccugcacgagaagguccggucccagcuccgcgacaacgccaacgaccugggcaacgggugcuucgaguucuggcacaagugcgacaacgagugcauggagagcgugaagaacggcaccuacgacuaccccaaguaccagaccgagucccggcugaaccgccagaagaucgagagcgucaagcucgagaacuucgacguguaccagauccuggcgaucuacuccacggugucguccagccugguccucguggggcugaucauggccaugggccuguggaugugcuccaacggcagcaugcagugccggaucugcaucuga

SEQ ID NO: 11368 - RNA, 1701 nt, Artificial Sequence
  derived and/or modified CDS sequence (AUadapt) from InfluenzaA__AHJ58013__HA
augaucgccuuuaucgugaucgccauccuggucaccaccggcaagucggacaagaucugcaucggguaccacgcgaacaacuccacgaccaagguggacaccauccucgagaagaacgugaccgucacgcacagcguggagcugcuggagaaccagaaggaggagcgcuucugcaagaucuccagcaaggcgccccucgaccugcgggacugcucccuggagggcuggauccucgggaacccgcgcugcggcauccugcuggccgaucagagcugguccuacaucguggagcggcccaacgcccgcaacgggaucugcuaccccggcacccucaacgaggucgaggagcugaaggcccugaucggcagcggggagcggguggagcgcuucgagauguuccccaaguccaccugggccggcguggacaccaacucgggggucuccagcgccugcccgcucggcgaggggcccuccuucuaccggaaccugcuguggaucaucaagcgcacgaccagcgaguaccccgugaucaagggcaccuaccggaauaccggcgacaaguccgugcucuacuucuggggcguccaccacccgcccgacacgaccgagcagaacgugcuguacgggagcgggaaccgcuacgugcggaugggcaccgaguccaugaacuucgcccgcagccccgagaucgccgcgcggcccgccgucaacggccagcgcgggcggaucgacuacuucugguccauccugaagcccggcgagacccucgacguggagucgaaugggaaccugaucgccccgugguacgccuaccgcuucgugaacaaggagagcaagggcgccaucuuccgguccaaccugcccaucgagaacugcgacgcgacgugccagaccaccgagggggucauccgcaccaacaagacguuccagaacgugagcccccucuggaucggcgagugccccaaguacgugaaguccaagagccugcggcuggccaccggccuccgcaacgucccgcagaucgagacccgggggcuguucggcgccaucgccggguuuaucgagggcggguggaccggcaugaucgacggcugguacggguaccaccacgagaacucccagggcagcggguacgccgcggacaaggaguccacgcagaaggccaucgacggcaucaccaacaaggugaacucgaucaucgacaagaugaacacccaguucgaggccguggggcacgaguucuccacccuggagcgccgcaucgacaaccucaauaagcggauggaggacggcuuccuggacgucuggacguacaacgccgagcugcucgugcugcuggagaacgagcgcacccucgaccugcacgacgccaacgucaagaaccugcacgagcgggugcgcagccagcuccgggacaacgcgaacgaccugggcaacgggugcuucgaguucuggcauaagugcgacaacgagugcauggaguccgugaagaacggcaccuacaacuaccccaaguaccaggccgagagccgccugaacaagcagaagaucgaguccgucaagcucgaggaguucgggguguaccagauccuggccaucuacagcaccguguccagcucccugguccucgugggccugaucauggccaugggccuguggaugugcagcaacggguccaugcagugccggaucugcaucuga

SEQ ID NO: 11369 - RNA, 1701 nt, Artificial Sequence
  derived and/or modified CDS sequence (AUadapt) from InfluenzaA__AHJ58025__HA
augaucgccuucaucgugaucgccauccuggucaccaccggcgagucggacaagaucugcaucggguaccacgcgaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcaccaucgagggcuggauccuggggaacccgcgcugcggcauccuccuggccgaccagucgugguccuacaucguggagcggcccaacgcccgcaacgggaucugcuaccccggcacccugaacgaggccgaggagcucaaggcccugaucggcagcggggagggcgucgagcgguucgagauguuccccaaguccaccugggccgggguggacacgaacucgggcguguccagcgccugcccgcuggggaacggccccuccuucuaccgcaaccuccuguggaucaucaagcugaaguccuccgaguaccccgucauccggggcaccuucaacaacaccggggacaagucggugcucuacuucuggggcgugcaccacccgcccgucaccacggagcagaacgaccuguacggguccggcaaccgcuacgugcggaugggcaccgagagcaugaacuucgcccgcaaccccgagaucgcgcugcggcccgccgugaacgggcagcgcggccggaucgacuacuucugguccauccucaagcccggggagacccugaacgucgagucgaacggcaaccugaucgccccgugguacgccuaccgcuucgugaacaaggacuccaagggggccaucuuccggagcucgcuccccaucgagaacugcgacgcgaccugccagacggccgagggcgugauccgcaccaacaagaccuuccagaacgucagcccccuguggaucggcgagugccccaaguacgucaagucgaagucccugcggcucgccaccgggcugcgcaacgugccgcagaucgagacgcggggccuguucggggccaucgccggcuucaucgagggcggguggaccggcaugguggacgggugguacggcuaccaccacgagaacagccagggguccggcuacgcggccgaccgcgagucgacccagaaggccaucgacgggaucaccaacaaggugaacuccaucaucgacaagaugaacacgcaguucgaggccguggaccacgaguucagcaaccucgagcggcgcaucgacaaccugaacaagcgcauggaggacggcuuccuggacgucuggaccuacaacgccgagcuccuggugcugcucgagaacgagcggacccuggaccugcacgacgcgaacgucaagaaccuccacgagaaggugaagucccagcugcgcgacaacgccaacgaccugggcaacgggugcuucgaguucuggcacaagugcgacaacgagugcauggagucggugaagaacggcaccuacaacuaccccaaguaccagaaggagucccggcucaaccgccagaagaucgagagcgucaagcuggagaacuucgacguguaccagauccuggccaucuacuccacggugucguccagccucguccugguggggcugaucauggccaugggccucuggaugugcuccaacggcagcaugcagugccggaucugcaucuga

SEQ ID NO: 11370 - RNA, 1701 nt, Artificial Sequence
  derived and/or modified CDS sequence (AUadapt) from InfluenzaA__AHJ58037__HA
augaucgccuucaucaucaucaccauccuggugaccacgggcgagucggacaagaucugcaucggguaccacgccaacaacuccaccaccaaggucgacaccauccucgagaagaacgugacggugacccacagcgucgagcugcuggagaaccagaaggaggagcgcuucugcaagaucuccaacaaggcgccccucgaccugaaggagugcacccuggagggcuggauccucgggaacccgcagugcgaccugcugcucggcgaccagagcugguccuacaucguggagcggcccaacgcccgcaacgggaucugcuaccccggcacccugaacgagguggaggagcugaaggcccucaucggcucgggggagcgggucgagcgcuucgagauguuccccaaguccacgugggccggcguggacaccaacagcggggugacccgguccugcccguucggcagcggguccagcuucuaccgcaaccugcuguggaucaucaagcacaccacguccucguaccccgucaucaagggcaccuuccggaacaccggcgacaaguccgugcucuacuucuggggcgugcaccaccccaucgacaccacggagcagaacguccuguacgggagcgggaaccgcuacgugcggaugggcaccgaguccaugaacuucgcccgcagccccgagaucgcggcccggccgguggucaacggccagcgcgggcggaucgacuacuucugguccauccugaagcccggcgagacccucaacaucgagucgaacgggaaccugaucgcccccugguacgccuaccgcuucgugaacaaggacagcaagggcgcgaucuuccgguccaaccugcccaucgagaacugcgacgcgaccugccagacgaucgagggggugauccgcaccaacaagaccuuccagaacgucagcccgcucuggaucggcgagugccccaaguacgugaaguccgagagccugcggcuggccaccggccuccgcaacgugccccagaucgagacgcgggggcuguucggcgccaucgccggguucaucgagggcggguggaccggcaugaucgacggcugguacggguaccaccacgagaacucccagggcucgggguacgccgccgaccgcgaguccacccagcgggccaucgacggcaucaccacgaaggucaacagcaucaucgacaagaugaacacccaguucgaggccguggggcacgaguucuccaaccuggagcgccgcaucgacaaccucaacaagcggauggaggacggcuuccuggacguguggaccuacaacgccgagcugcucguccugcuggagaacgagcgcacccucgaccugcacgacgcgaacgugaagaaccugcacgagcgggucaagagccagcuccgcgacaacgccaacgaccugggcaacgggugcuucgaguucuggcacaagugcgacaacgagugcauggaguccgugaagaacggcacguacgacuaccccaaguaccaggccgagucgcggcugaacaagcagcgcaucgaguccgugaagcucgagaacuucgacgucuaccagauccuggccaucuacagcaccguguccagcucccuggugcucgucgggcugaucauggccaucggccuguggaugugcagcaacggcuccaugcagugccggaucugcaucuga

SEQ ID NO: 11371 - RNA, 1701 nt, Artificial Sequence
  derived and/or modified CDS sequence (AUadapt) from InfluenzaA__AHJ58049__HA
augaucgccuuuaucgugaucgccauccuggcggccaccggcaagucggacaagaucugcaucggguaccacgccaacaacuccaccacgaaggucgacaccauccucgagaagaacgugaccgugacccacagcgucgagcugcuggagaaccagaaggaggagcgcuucugcaagaucuccaacaaggcgccccucgaccugcgggacugcacgcuggagggcuggauccucgggaacccgcgcugcggcauccugcuggccgaccagagcugguccuacaucguggagcggcccaacgcccgcaaugggaucugcuaccccggcauccucaacgaggccgaggagcugaaggcccugaucggcagcggggagcggguggagcgcuucgagauguuccccaaguccaccugggccggcgucgacaccgacucggggguguccagcgcgugcccgcucggcaacgggcccuccuucuaccggaaccugcuguggaucaucaagcucaagagcuccgaguaccccgugauccgcggcaccuucaacaacacgggcgacaagagcauccuguacuucuggggcguccaccauccgcccgugaccaccgagcaggaggcccuguacggguccgggaaccgguacgugcgcaugggcaccgagucgaugaacuucgcccggacgcccgagaucgccgcccgccccgcggucaacggccagcgggggcgcaucgacuacuucugguccauccucaagcccggcgagacccugaacguggagagcaacgggaaccugaucgccccgugguacgccuaccgguucgugaacaaggacuccaagggcgccaucuuccgcagcaaccuccccaucgagaacugcgacgcgaccugucagaccacggagggggucauccggaccaacaagaccuuccagaacgugagcccccuguggaucggcgagugccccaaguacgugaaguccaagucgcugcgccucgccaccggccugcggaacgucccgcagaucgagacgcgcgggcuguucggcgccaucgccggguucaucgagggcggguggaccggcaugaucgacggcugguacggguaccaccacgagaacucccagggcagcggguacgccgccgaccgggaguccacccagaaggcgaucgacggcaucaccaacaaggugaacagcaucaucgacaagaugaacacgcaguuugaggccguggggcacgaguucuccaaccucgagcgccgcaucgacaaccugaacaagcggauggaggacggcuuccuggacgucuggaccuacaacgccgagcuccuggugcugcucgagaacgagcgcacccuggaccugcacgacgccaacgugaagaaccuccacgagaagguccggagccagcugcgcgacaacgccaacgaccugggcaacgggugcuuugaguucuggcacaagugcgacaacgagugcauggaguccgugaagaacggcaccuacgacuaccccaaguaccaggcggagucgcggcucaaccgccagaagaucgaguccgucaagcuggagaacuucgacguguaccagauccuggccaucuacagcacgguguccagcucccucguccugguggggcugaucauggccaugggccucuggaugugcagcaacggcuccaugcagugccggaucugcaucuga

SEQ ID NO: 11372 - RNA, 1701 nt, Artificial Sequence
  derived and/or modified CDS sequence (AUadapt) from InfluenzaA__AHJ58061__HA
augaucgccuuuaucgugaucgccacccuggucgcgaccggcaagucggacaagaucugcaucggguaccacgccaacaacuccacgaccaagguggacaccauccucgagaagaacgugaccgucacgcacagcguggagcugcuggagaaccagaaggaggagcgcuucugcaagaucuccaacaaggcgccccucgaccugcgggacugcacccuggagggcuggauccucgggaacccgcgcugcggcauccugcuggccgaccagucgugguccuacaucguggagcggcccaacgcccgcaacgggaucugcuaccccggcacccucaacgaggccgaggagcugaaggcccugaucggcagcggggagcgggucgagcgcuucgagauguuccccaaguccaccuggacgggcguggacaccgagucggggguguccagcgccugcccgcucggcaacgggcccuccuucuaccggaaccugcuguggaucaucaagcucaagucguccgaguaccccgucauccgcggcaccuucaacaacaccggcgacaagagcauccuguacuucuggggcgugcaccacccgcccgugacgaccgagcagaacgcccuguacggguccggggaccgguacguccgcaugggcaccgagucgaugaacuucgcgcggucccccgagaucgccgcccgccccgccgugaacggccagcgggggcgcaucgacuacuucuggagcauccucaagcccggcgagacccugaacguggaguccaacgggaaccugaucgccccgugguacgcguaccgguucgucaacaaggacucgaagggcgccaucuuccgcagcaaccuccccaucgagaacugcgacgccacgugucagaccaccgagggggugauccggaccaacaagacguuccagaacgugucgccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacagccagggcuccggguacgccgccgacaaggagucgacgcagaaggccaucgacggcaucaccaacaaggugaacuccaucaucgacaagaugaacacccaguucgaggccgucgggcacgaguucagcaaccucgagcggcgcaucgacaaccugaacaagcgcauggaggacggcuuccuggacguguggaccuacaacgcggagcuccuggugcugcucgagaacgagcggacgcuggaccugcacgacgccaacgucaagaaccuccacgagaaggugcgcucccagcugcgggacaacgccaacgaccugggcaacgggugcuucgaguucuggcacaagugcaacaacgagugcauggagucggucaagaacggcaccuacgacuaccccaaguaccagaaggagucccgccucaaccggcagaagaucgagagcgugaagcuggagaacuucgacguguaccagauccuggccaucuacuccaccgucucguccagccucgugcugguggggcugauccucgccaugggccuguggaugugcuccaacggcagcaugcagugccgcaucugcaucuga

SEQ ID NO: 11373 - RNA, 1701 nt, Artificial Sequence
  derived and/or modified CDS sequence (AUadapt) from InfluenzaA__AHJ58084__HA
augaucgccuuuaucgugaucgccacccuggucgcgaccggcaagucggacaagaucugcaucggguaccacgccaacaacuccacgaccaagguggacaccauccucgagaagaacgugaccgucacgcacucgguggagcugcuggagaaccagaaggaggagcgcuucugcaagaucuccaacaaggcgccccucgaccugcgggacugcacccuggagggcuggauccucgggaacccgcgcugcggcauccugcuggccgaccagagcugguccuacaucguggagcggcccaacgcccgcaacgggaucugcuaccccggcacccucaacgaggccgaggagcugaaggcccugaucggcucgggggagcgggucgagcgcuucgagauguuccccaaguccaccuggacgggcgugaacaccgagagcgggguguccucggccugcccgcucggcaacgggcccuccuucuaccggaaccugcuguggaucaucaagcucaagagcuccgaguaccccgucauccgcggcaccuucaacaacaccggcgacaagucgauccuguacuucuggggcgugcaccacccgcccgugacgaccgagcagaacgcccuguacggguccggggaccgguacguccgcaugggcaccgagagcaugaacuucgcgcggucccccgagaucgccgcccgccccgccgugaacggccagcgggggcgcaucgacuacuucuggucgauccucaagcccggcgagacccugaacguggaguccaacgggaaccugaucgccccgugguacgcguaccgguucgucaacaaggacagcaagggcgccaucuuccgcucgaaccuccccaucgagaacugcgacgccacgugccagaccaccgagggggugauccggaccaacaagacguuccagaacgugagcccccuguggaucggcgagugccccaaguacgucaaguccaagucccugcgccucgccaccggccugcggaacgugccgcagaucgagacccgcgggcuguucggcgccaucgcgggguucaucgagggcggguggaccggcaugaucgacggcugguacggguaccaccacgagaacucgcagggcuccggguacgccgccgacaaggagagcacgcagaaggccaucgacggcaucaccaacaaggugaacuccaucaucgacaagaugaacacccaguucgaggccgucgggcacgaguucucgaaccucgagcggcgcaucgacaaccugaacaagcgcauggaggacggcuuccuggacguguggaccuacaacgcggagcuccuggugcugcucgagaacgagcggacgcuggaccugcacgacgccaacgucaagaaccuccacgagaaggugcgcucccagcugcgggacaacgccaacgaccugggcaacgggugcuucgaguucuggcacaagugcaacaacgagugcauggagagcgucaagaacggcaccuacgacuaccccaaguaccagaaggagucccgccucaaccggcagaagaucgagucggugaagcuggagaacuucgacguguaccagauccuggccaucuacuccaccgucagcuccucgcucgugcugguggggcugauccucgccaugggccuguggaugugcuccaacggcagcaugcagugccgcaucugcaucuga

SEQ ID NO: 11374 - RNA, 1701 nt, Artificial Sequence; identical to SEQ ID NO: 7100
  derived and/or modified CDS sequence (AUadapt) from InfluenzaA__AHL80708__HA

SEQ ID NO: 11375 - RNA, 1701 nt, Artificial Sequence
  derived and/or modified CDS sequence (AUadapt) from InfluenzaA__AHL80718__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaucagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgucggugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 11376 - RNA, 1710 nt, Artificial Sequence
  derived and/or modified CDS sequence (AUadapt) from InfluenzaA__AHL80729__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugaccucgcugcccuuccagaacgugcaccccaucaccaucgggaagugccccaaguacgucaaguccaccaagcuccggcuggcgacgggccugcgcaacgugccgagcauccagucccggggccucuucggggccaucgccggguucaucgagggcggcuggaccgggaugguggacggcugguacggguaccaccaccagaacgagcagggcagcggguacgccgccgaccugaaguccacccagaacgcgaucgacgagaucaccaacaaggucaacucggugaucgagaagaugaacacgcaguucaccgccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgggaggagaucgacggcgucaagcuggaguccacccgcaucuaccagauccuggcgaucuacagcaccguggccucgucccucgugcuggucgugagccugggggccaucuccuucuggaugugcagcaacggcucccuccagugccggaucugcaucuga

SEQ ID NO: 11377 - RNA, 1701 nt, Artificial Sequence
  derived and/or modified CDS sequence (AUadapt) from InfluenzaA__AHL80740__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucagcaccgcguccucgugguccuacaucguggagaccagcuccucggacaacggcacgugcuaccccggcgacuucaucaacuacgaggagcugcgggagcagcuguccagcguguccucguucgagcgcuucgagaucuuccccaagaccuccagcuggcccaaccacgacuccaacaagggggucaccgccgccugcccgcacgccggcgccaagucguucuacaagaaccucaucuggcuggugaagaaggggaacuccuaccccaagcugagcaaguccuacaucaacgacaagggcaaggaggugcucguccuguggggcgugcaccaccccucgaccagcgccgaccagcagucccuguaccagaacgccgacgccuacguguucgucgggacgucgcgguacuccaagaaguucaagcccgagaucgccauccgcccgaaggugcgggaccaggagggccgcaugaacuacuacuggacccucguggagcccggggacaagaucaccuucgaggcgaccggcaaccuggucgugccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgucaaguccaccaagcuccggcuggcgaccggccugcgcaacgugccgagcauccagucccggggccucuucggggccaucgccggguucaucgagggcggcuggacggggaugguggacggcugguacggguaccaccaccagaacgagcagggcucgggguacgccgccgaccugaaguccacccagaacgcgaucgacaagaucaccaacaaggucaacagcgugaucgagaagaugaacacccaguucacggccgucggcaaggaguucaaccaccuggagaagcgcaucgagaaccucaacaagaagguggacgacggcuuccuggacaucuggaccuacaacgccgagcugcucgugcugcuggagaacgagcggacccucgacuaccacgacuccaacgucaagaaccuguacgagaaggugcgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgucaagcuggaguccacccgcaucuaccagauccuggcgaucuacucgaccguggccuccagccucgugcuggucgugucgcugggggccaucuccuucuggaugugcagcaacggcucccuccagugccggaucugcaucuga

SEQ ID NO: 11378 - RNA, 1701 nt, Artificial Sequence
  derived and/or modified CDS sequence (AUadapt) from InfluenzaA__AHL80751__HA
augaaggccauccuggugguccuccuguacaccuucgccaccgcgaacgccgacacgcugugcaucggcuaccacgccaacaacucgaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggugaccgccgccugcccgcacgccggcgcgaaguccuucuacaagaaccugaucuggcucgucaagaaggggaacucguaccccaagcuguccaagagcuacaucaacgacaagggcaaggagauccuggugcucugggggauccaccaccccucgaccuccgccgaccagcagagccuguaccagaacgccgacgccuacguguucgucggcacgucccgguacucgaagaaguucaagcccgagaucgccauccgcccgaaggugcgggaccaggagggccgcaugaacuacuacuggacccugguggagcccggggacaagaucaccuucgaggcgaccggcaaccucgucgugccccgguacgccuucgccauggagaagaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggucaacuccgugaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagguggggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 11379 - RNA, 1701 nt, Artificial Sequence
  derived and/or modified CDS sequence (AUadapt) from InfluenzaA__AHL80762__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggauccugguggagcccggggacaagaucaccuucgaggcgaccggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacgcagaacgcgaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcucccagcugaaggacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaucuaccagauccuggcgaucuacuccaccgucgccagcucgcuggugcucguggucucccugggggccaucagcuucuggaugugcuccaacggcagccugcagugccggaucugcaucuga

SEQ ID NO: 11380 - RNA, 1701 nt, Artificial Sequence
  derived and/or modified CDS sequence (AUadapt) from InfluenzaA__AHL80784__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaaggggaucaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccuccgccgaccagcagagccuguaccagaacgccgacgccuacgucuucgugggcacgucccgguacucgaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgagccugguccucguggugucccugggggccaucucguucuggaugugcuccaacggcagccugcagugccggaucugcaucuga

SEQ ID NO: 11381 - RNA, 1701 nt, Artificial Sequence; identical to SEQ ID NO: 4078
  derived and/or modified CDS sequence (AUadapt) from InfluenzaA__AHL80795__HA

SEQ ID NO: 11382 - RNA, 1701 nt, Artificial Sequence
  derived and/or modified CDS sequence (AUadapt) from InfluenzaA__AHL80817__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagucgcuguccaccgccagcuccuggucguacaucguggaggccuccagcuccgacaacgggaccugcuaccccggcgacuucaucgacuacgaggagcuccgggagcagcugucguccgugagcuccuucgagcgcuucgagaucuuccccaagacgucguccuggcccaaccacgacagcaacaagggcgucaccgccgccugcccgcacgcgggcgccaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcaccucccgguacucgaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagucgaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagucgacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 11383 - RNA, 1701 nt, Artificial Sequence; identical to SEQ ID NO: 11382
  derived and/or modified CDS sequence (AUadapt) from InfluenzaA__AHL80828__HA

SEQ ID NO: 11384 - RNA, 1701 nt, Artificial Sequence
  derived and/or modified CDS sequence (AUadapt) from InfluenzaA__AHL80839__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaaggggaucaccgccgccugcccgcacgccggcgcgaaguccuucuacaagaaccugaucuggcucgucaagaaggggaacucguaccccaagcugucccggagcuacaucaacgacaagggcaaggaggugcuggugcucugggggauccaccaccccucgaccuccgccgaccagcagagccuguaccagaacgccgacgccuacgucuucgugggcacgucccgcuacucgaagaaguucaagcccgagaucgccauccggccgaaggugcgcgaccaggagggccggaugaacuacuacuggacccuggucgagcccggggacaagaucaccuucgaggcgaccggcaaccucguggugccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 11385 - RNA, 1701 nt, Artificial Sequence
  derived and/or modified CDS sequence (AUadapt) from InfluenzaA__AHL80861__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucggcaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagagcacccgcaucuaccagauccuggcgaucuacuccaccgucgccucgagccuggugcucguggucucccugggcgccaucucguucuggaugugcuccaacggcagccugcagugccggaucugcaucuga

SEQ ID NO: 11386 - RNA, 1701 nt, Artificial Sequence
  derived and/or modified CDS sequence (AUadapt) from InfluenzaA__AHL80872__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaacgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 11387 - RNA, 1701 nt, Artificial Sequence; identical to SEQ ID NO: 4078
  derived and/or modified CDS sequence (AUadapt) from InfluenzaA__AHL80883__HA

SEQ ID NO: 11388 - RNA, 1701 nt, Artificial Sequence; identical to SEQ ID NO: 4078
  derived and/or modified CDS sequence (AUadapt) from InfluenzaA__AHL80894__HA

SEQ ID NO: 11389 - RNA, 1701 nt, Artificial Sequence; identical to SEQ ID NO: 4078
  derived and/or modified CDS sequence (AUadapt) from InfluenzaA__AHL80905__HA

SEQ ID NO: 11390 - RNA, 1701 nt, Artificial Sequence; identical to SEQ ID NO: 6699
  derived and/or modified CDS sequence (AUadapt) from InfluenzaA__AHL80916__HA

SEQ ID NO: 11391 - RNA, 1701 nt, Artificial Sequence; identical to SEQ ID NO: 7100
  derived and/or modified CDS sequence (AUadapt) from InfluenzaA__AHL80927__HA

SEQ ID NO: 11392 - RNA, 1701 nt, Artificial Sequence; identical to SEQ ID NO: 7100
  derived and/or modified CDS sequence (AUadapt) from InfluenzaA__AHL80946__HA

SEQ ID NO: 11393 - RNA, 1701 nt, Artificial Sequence
  derived and/or modified CDS sequence (AUadapt) from InfluenzaA__AHL80958__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaucagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgucggugcacgacugcaacacgaccugccagacccccaagggcgccaucaacaccucccugccguuccagaacauccaccccaucaccaucgggaagugccccaaguacgucaagagcaccaagcugcggcucgcgaccggccugcgcaacgugcccuccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacucgaccgucgccuccagccuggugcucguggucucgcugggggccaucuccuucuggaugugcagcaacggcucccugcagugccggaucugcaucuga

SEQ ID NO: 11394 - RNA, 1701 nt, Artificial Sequence
  derived and/or modified CDS sequence (AUadapt) from InfluenzaA__AHL81001__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagucguccagcaccggggagaucugcaacucgccccaccagauccucgacggcgagaacugcacccugaucgacgcccugcucggggacccccagugcgacggcuuccagaacaagaagugggaccuguucgucgagcgcucgaaggcccacuccaacugcuaccccuacgacgugccggacuacgcgagccugcggucccucguggccucguccggcacgcuggaguucaacaacgagucguucaacuggaccggggucacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccgccgggcggaucaccgucucgacgaagcgcucccagcaggccgugaucccgaacaucggcagccggccccgcgugcggaacauccccucgcgcgucuccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 11395 - RNA, 1701 nt, Artificial Sequence; identical to SEQ ID NO: 7100
  derived and/or modified CDS sequence (AUadapt) from InfluenzaA__AHL81013__HA

SEQ ID NO: 11396 - RNA, 1701 nt, Artificial Sequence; identical to SEQ ID NO: 7100
  derived and/or modified CDS sequence (AUadapt) from InfluenzaA__AHL81025__HA

SEQ ID NO: 11397 - RNA, 1701 nt, Artificial Sequence; identical to SEQ ID NO: 7100
  derived and/or modified CDS sequence (AUadapt) from InfluenzaA__AHL81037__HA

SEQ ID NO: 11398 - RNA, 1701 nt, Artificial Sequence; identical to SEQ ID NO: 7100
  derived and/or modified CDS sequence (AUadapt) from InfluenzaA__AHL81049__HA

SEQ ID NO: 11399 - RNA, 1701 nt, Artificial Sequence; identical to SEQ ID NO: 11393
  derived and/or modified CDS sequence (AUadapt) from InfluenzaA__AHL81061__HA

SEQ ID NO: 11400 - RNA, 1701 nt, Artificial Sequence; identical to SEQ ID NO: 11393
  derived and/or modified CDS sequence (AUadapt) from InfluenzaA__AHL81072__HA

SEQ ID NO: 11401 - RNA, 1701 nt, Artificial Sequence; identical to SEQ ID NO: 8606
  derived and/or modified CDS sequence (AUadapt) from InfluenzaA__AHL81083__HA

SEQ ID NO: 11402 - RNA, 1701 nt, Artificial Sequence; identical to SEQ ID NO: 7100
  derived and/or modified CDS sequence (AUadapt) from InfluenzaA__AHL81095__HA

SEQ ID NO: 11403 - RNA, 1701 nt, Artificial Sequence
  derived and/or modified CDS sequence (AUadapt) from InfluenzaA__AHL81118__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccaacagcuggcccaaccacgacuccaacaagggggucaccgccgccugcccgcacgccggcgccaagucguucuacaagaaccugaucuggcucgugaagaaggggaacuccuaccccaagcugucgaaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacucgaccgucgccuccagccuggugcucguggucucccugggggccaucucguucuggaugugcagcaacggcucccugcagugccggaucugcaucuga

SEQ ID NO: 11404 - RNA, 1701 nt, Artificial Sequence; identical to SEQ ID NO: 7100
  derived and/or modified CDS sequence (AUadapt) from InfluenzaA__AHL81129__HA

SEQ ID NO: 11405 - RNA, 1701 nt, Artificial Sequence; identical to SEQ ID NO: 7100
  derived and/or modified CDS sequence (AUadapt) from InfluenzaA__AHL81141__HA

SEQ ID NO: 11406 - RNA, 1701 nt, Artificial Sequence; identical to SEQ ID NO: 7100
  derived and/or modified CDS sequence (AUadapt) from InfluenzaA__AHL81153__HA

SEQ ID NO: 11407 - RNA, 1701 nt, Artificial Sequence
  derived and/or modified CDS sequence (AUadapt) from InfluenzaA__AHL81165__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 11408 - RNA, 1701 nt, Artificial Sequence; identical to SEQ ID NO: 11407
  derived and/or modified CDS sequence (AUadapt) from InfluenzaA__AHL81177__HA

SEQ ID NO: 11409 - RNA, 1701 nt, Artificial Sequence; identical to SEQ ID NO: 11394
  derived and/or modified CDS sequence (AUadapt) from InfluenzaA__AHL81189__HA

SEQ ID NO: 11410 - RNA, 1701 nt, Artificial Sequence
  derived and/or modified CDS sequence (AUadapt) from InfluenzaA__AHL81212__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaagaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgcgaucuccugcuuccuccugugcgucgcccugcucggcuucaucaugugggccugccagaaggggaacauccggugcaacaucugcaucuga

SEQ ID NO: 11411 - RNA, 1701 nt, Artificial Sequence
  derived and/or modified CDS sequence (AUadapt) from InfluenzaA__AHL81224__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaccgccggcuccggcaucaucaucucggacacccccgugcacgacugcaacacgaccugccagaccccgaagggggccaucaacaccucccugcccuuccagaacauccaccccaucacgaucggcaagugccccaaguacgucaagucgaccaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 11412 - RNA, 1701 nt, Artificial Sequence; identical to SEQ ID NO: 7100
  derived and/or modified CDS sequence (AUadapt) from InfluenzaA__AHL81235__HA

SEQ ID NO: 11413 - RNA, 1701 nt, Artificial Sequence; identical to SEQ ID NO: 7100
  derived and/or modified CDS sequence (AUadapt) from InfluenzaA__AHL81247__HA

SEQ ID NO: 11414 - RNA, 1701 nt, Artificial Sequence; identical to SEQ ID NO: 7100
  derived and/or modified CDS sequence (AUadapt) from InfluenzaA__AHL81259__HA

SEQ ID NO: 11415 - RNA, 1701 nt, Artificial Sequence; identical to SEQ ID NO: 7100
  derived and/or modified CDS sequence (AUadapt) from InfluenzaA__AHL81271__HA

SEQ ID NO: 11416 - RNA, 1701 nt, Artificial Sequence; identical to SEQ ID NO: 7100
  derived and/or modified CDS sequence (AUadapt) from InfluenzaA__AHL81283__HA

SEQ ID NO: 11417 - RNA, 1701 nt, Artificial Sequence; identical to SEQ ID NO: 7100
  derived and/or modified CDS sequence (AUadapt) from InfluenzaA__AHL81295__HA

SEQ ID NO: 11418 - RNA, 1701 nt, Artificial Sequence; identical to SEQ ID NO: 11393
  derived and/or modified CDS sequence (AUadapt) from InfluenzaA__AHL81307__HA

SEQ ID NO: 11419 - RNA, 1701 nt, Artificial Sequence; identical to SEQ ID NO: 7112
  derived and/or modified CDS sequence (AUadapt) from InfluenzaA__AHL81329__HA

SEQ ID NO: 11420 - RNA, 1701 nt, Artificial Sequence
  derived and/or modified CDS sequence (AUadapt) from InfluenzaA__AHL81340__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccaggacggcaccuccucggccugcauccgcggguccaagaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccgcaucaccguguccacgaagcggucgcagcaggccgccaucccgaacaucggcucgcgcccccgggugcgcaacauccccucccggaucagcaucuacuggaccaucgucaagcccggggacauccugcucaucaacuccaccggcaaccugaucgccccgcgcggguacuucaagauccggucgggcaaguccagcaucaugcgcuccgacgcgcccaucggcaagugcaacucggagugcaucacccccaacggguccauccccaacgacaagccguuccagaacgugaaccggaucacguacggcgccugcccccgcuacgugaagcagaacacccugaagcucgccaccgggaugcggaacguccccgagaagcagacccgcggcaucuucggggccaucgccggcuucaucgagaacggcugggaggggaugguggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacaaccacgacguguaccgcgacgaggcccucaacaagcgguuccagaucaagggcaucgagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 11421 - RNA, 1701 nt, Artificial Sequence; identical to SEQ ID NO: 7100
  derived and/or modified CDS sequence (AUadapt) from InfluenzaA__AHL81352__HA

SEQ ID NO: 11422 - RNA, 1701 nt, Artificial Sequence
  derived and/or modified CDS sequence (AUadapt) from InfluenzaA__AHL81364__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcgccugcuaccccggcgacuucaucaacuacgaggagcuccgggagcagcugagcuccgugucguccuucgagcgcuucgagaucuuccccaagacgaacagcuggcccaaccacgacuccaacaagggggucaccgccgccugcccgcacgcgggcgccaagucguucuacaagaaccugaucuggcucgugaagaaggggaacuccuaccccaagcugucgaaguccuacaucaacgacaagggcaaggaggugcugguccucugggggauccaccaccccagcaccaccgccgaccagcagucgcuguaccagaacgccgacgccuacguguucgugggcacgucccgguacagcaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucgccauggagcgcaacgccggguccggcaucaucaucucggacacgcccgugcacgacugcaacacgaccugccagaccccgaagggcgcgaucaacaccucccugcccuuccagaacauccaccccaucaccaucgggaagugccccaaguacgucaagucgaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagucgacccagaacgccaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggcgaagcugaaccgggaggagaucgacggcgugaagcucgaguccacccgcaucuaccagauccuggccaucuacucgaccgucgccuccagccuggugcucguggucucccugggggccaucucguucuggaugugcagcaacggcucccugcagugccggaucugcaucuga

SEQ ID NO: 11423 - RNA, 1701 nt, Artificial Sequence
  derived and/or modified CDS sequence (AUadapt) from InfluenzaA__AHL81386__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccaacucguggcccaaccacgacuccaacaagggggucaccgccgccugcccgcacgccggcgucaagucguucuacaagaaccugaucuggcucgugaagaaggggaacuccuaccccaagcugagcaaguccuacaucaacgacaagggcaaggaggugcuggugcucugggggauccaccaccccucgaccacggcggaccagcagagccuguaccagaacgccgacgccuacguguucgucggcaccucccgguacucgaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggucaacuccgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacucgaacgucaagaaccucuacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacucgaccguggcguccagccuggugcucgucgugucccugggggccaucucguucuggaugugcagcaacggcucccugcagugccggaucugcaucuga

SEQ ID NO: 11424 - RNA, 1701 nt, Artificial Sequence; identical to SEQ ID NO: 7100
  derived and/or modified CDS sequence (AUadapt) from InfluenzaA__AHL81397__HA

SEQ ID NO: 11425 - RNA, 1701 nt, Artificial Sequence; identical to SEQ ID NO: 11410
  derived and/or modified CDS sequence (AUadapt) from InfluenzaA__AHL81409__HA

SEQ ID NO: 11426 - RNA, 1701 nt, Artificial Sequence; identical to SEQ ID NO: 11380
  derived and/or modified CDS sequence (AUadapt) from InfluenzaA__AHL81419__HA

SEQ ID NO: 11427 - RNA, 1701 nt, Artificial Sequence; identical to SEQ ID NO: 4078
  derived and/or modified CDS sequence (AUadapt) from InfluenzaA__AHL81430__HA

SEQ ID NO: 11428 - RNA, 1701 nt, Artificial Sequence; identical to SEQ ID NO: 875
  derived and/or modified CDS sequence (AUadapt) from InfluenzaA__AHL88951__HA

SEQ ID NO: 11429 - RNA, 1701 nt, Artificial Sequence; identical to SEQ ID NO: 875
  derived and/or modified CDS sequence (AUadapt) from InfluenzaA__AHL89030__HA

SEQ ID NO: 11430 - RNA, 1701 nt, Artificial Sequence
  derived and/or modified CDS sequence (AUadapt) from InfluenzaA__AHL89042__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagaacuucaacuggaccggggugacccagaacggcaccagcuccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccuggucggcuucaucaugugggccugccagaaggggaacauccggugcaacaucugcaucuga

SEQ ID NO: 11431 - RNA, 1701 nt, Artificial Sequence
  derived and/or modified CDS sequence (AUadapt) from InfluenzaA__AHL89054__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaugagcugcuuccuccugugcguggcccugcucggguucaucaugugggccugccagaagggcaacauccggugcaacaucugcaucuga

SEQ ID NO: 11432 - RNA, 1701 nt, Artificial Sequence; identical to SEQ ID NO: 1826
  derived and/or modified CDS sequence (AUadapt) from InfluenzaA__AHL89066__HA

SEQ ID NO: 11433 - RNA, 1701 nt, Artificial Sequence
  derived and/or modified CDS sequence (AUadapt) from InfluenzaA__AHL89078__HA
augaagaccaucaucgcccugucguacauccucugccugguguucgcccagaagcugcccggcgacgacaacuccaccgcgacgcucugccuggggcaccacgccgucccgaacggcaccguggugaagaccaucaccaacgaccagaucgaggucacgaacgccaccgagcuggugcagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgucccggacuacgcgucgcugcggucccucguggccagcuccgggacgcuggaguucaacaacgagucguucaacuggaccggcgugacccagaacgggaccuccucggccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucuuccuguacgcgcaggccucgggccggaucaccguguccacgaagcgcagccagcagaccgucaucccgaacaucggcucgcggccccgcgugcggaacauccccucccgcaucagcaucuacuggaccaucgugaagcccggggacauccugcucaucaacuccaccggcaaccugaucgccccgcggggguacuucaagauccgcucgggcaaguccucgaucaugcgguccgacgcccccaucggcaagugcaacagcgagugcaucacgcccaacggguccauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 11434 - RNA, 1701 nt, Artificial Sequence
  derived and/or modified CDS sequence (AUadapt) from InfluenzaA__AHL89090__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucccccuaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagagcuucaacuggaccggcgugacccagaacgggaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucagcaucuacuggaccaucgugaagcccggggacauccugcucaucaacuccaccggcaaccugaucgccccgcggggguacuucaagauccgcucgggcaaguccagcaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcucaagucgggcuacaaggacuggauccuguggaucuccuucgccaucagcugcuuccugcugugcguggcccugcucggguucaucaugugggccugccagaagggcaacauccggugcaacaucugcaucuga

SEQ ID NO: 11435 - RNA, 1701 nt, Artificial Sequence; identical to SEQ ID NO: 875
  derived and/or modified CDS sequence (AUadapt) from InfluenzaA__AHL89102__HA

SEQ ID NO: 11436 - RNA, 1701 nt, Artificial Sequence; identical to SEQ ID NO: 875
  derived and/or modified CDS sequence (AUadapt) from InfluenzaA__AHL89114__HA

SEQ ID NO: 11437 - RNA, 1701 nt, Artificial Sequence
  derived and/or modified CDS sequence (AUadapt) from InfluenzaA__AHL89126__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccucguccgggacgcuggaguucaacaacgagaacuucaacuggaccggcgugacccagaacgggaccagcuccgccugcaagcgccggucgaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugucgacgaagcgcucccagcagaccgugaucccgaacaucggcucgcggccccgcguccggaacauccccagccgcaucuccaucuacuggaccaucgugaagcccggggacauccugcucaucaacucgaccggcaaccugaucgccccgcggggguacuucaagauccgcuccggcaagagcuccaucaugcggucggacgcccccaucggcaagugcaacuccgagugcaucacgcccaacgggucgauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 11438 - RNA, 1701 nt, Artificial Sequence
  derived and/or modified CDS sequence (AUadapt) from InfluenzaA__AHL89138__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcagagcuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagucgacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 11439 - RNA, 1701 nt, Artificial Sequence
  derived and/or modified CDS sequence (AUadapt) from InfluenzaA__AHL89150__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcucgcagcagaccgugaucccgaacaucggcagccggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucgucuucaucaugugggccugccagaaggggaacauccggugcaacaucugcaucuga

SEQ ID NO: 11440 - RNA, 1701 nt, Artificial Sequence
  derived and/or modified CDS sequence (AUadapt) from InfluenzaA__AHL89162__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacgcuggaguucaacaacgagucguucaacuggaccggcgugacccagaacgggaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucggcucgcggccccgcguccggaacauccccucccgcaucucgaucuacuggaccaucgugaagcccggggacauccugcucaucaacuccaccggcaaccugaucgccccgcggggguacuucaagauccgcagcggcaaguccucgaucaugcgguccgacgcccccaucggcaagugcaacucggagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaccaaccagaucaacggcaagcugaaccggcucaucggcaagacgaacgagaaguuccaccagaucgagaaggaguucucggaggucgaggggcgcauccaggaccuggagaaguacguggaggacaccaagaucgaccugugguccuacaacgccgagcuccugguggcccuggagaaccagcacaccaucgaccucaccgacucggagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 11441 - RNA, 1701 nt, Artificial Sequence
  derived and/or modified CDS sequence (AUadapt) from InfluenzaA__AHL89174__HA
augaagaccaucaucgcccugucguacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagucguccagcaccgggggcaucugcgacucgccccaccagauccucgacggggagaacugcacgcugaucgacgcccugcucggcgacccccagugcgacggcuuccagaacaagaagugggaccuguucguggagcgcucgaaggccuacuccaacugcuaccccuacgacgugccggacuacgcgagccugcggucccucgucgccucguccgggacccuggaguucaacaacgagagcuucaacuggaccggcgugacccagaacgggacguccucggccugcaagcgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucacgguguccaccaagcgcucgcagcagaccgugaucccgaacaucggcucgcggccccgcguccggaacauccccucccgcaucagcaucuacuggaccaucgugaagcccggggacauccugcucaucaacuccacgggcaaccugaucgccccgcggggguacuucaagauccgcucgggcaaguccagcaucaugcgguccgacgcccccaucggcaagugcaacucggagugcaucacccccaacggguccauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacucggagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacucggagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 11442 - RNA, 1701 nt, Artificial Sequence
  derived and/or modified CDS sequence (AUadapt) from InfluenzaA__AHL89210__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11443 - RNA, 1701 nt, Artificial Sequence; identical to SEQ ID NO: 11442
  derived and/or modified CDS sequence (AUadapt) from InfluenzaA__AHL89222__HA

SEQ ID NO: 11444 - RNA, 1701 nt, Artificial Sequence
  derived and/or modified CDS sequence (AUadapt) from InfluenzaA__AHL89234__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaugggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11445 - RNA, 1701 nt, Artificial Sequence
  derived and/or modified CDS sequence (AUadapt) from InfluenzaA__AHL89246__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgggaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 11446 - RNA, 1701 nt, Artificial Sequence
  derived and/or modified CDS sequence (AUadapt) from InfluenzaA__AHL89258__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccaggcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugauccccaacaucggcagccggccgcgcguccggaacauccccucccgcaucucgaucuacuggaccaucgugaagcccggcgacauccugcucaucaacuccaccgggaaccugaucgcgccccggggcuacuucaagauccgcagcgggaaguccucgaucaugcgguccgacgccccgaucggcaagugcaacagcgagugcaucacgcccaacggcuccauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 11447 - RNA, 1701 nt, Artificial Sequence; identical to SEQ ID NO: 11442
  derived and/or modified CDS sequence (AUadapt) from InfluenzaA__AHL89270__HA

SEQ ID NO: 11448 - RNA, 1701 nt, Artificial Sequence; identical to SEQ ID NO: 11442
  derived and/or modified CDS sequence (AUadapt) from InfluenzaA__AHL89282__HA

SEQ ID NO: 11449 - RNA, 1701 nt, Artificial Sequence; identical to SEQ ID NO: 11442
  derived and/or modified CDS sequence (AUadapt) from InfluenzaA__AHL89294__HA

SEQ ID NO: 11450 - RNA, 1701 nt, Artificial Sequence; identical to SEQ ID NO: 11442
  derived and/or modified CDS sequence (AUadapt) from InfluenzaA__AHL89306__HA

SEQ ID NO: 11451 - RNA, 1701 nt, Artificial Sequence; identical to SEQ ID NO: 1826
  derived and/or modified CDS sequence (AUadapt) from InfluenzaA__AHL89318__HA

SEQ ID NO: 11452 - RNA, 1701 nt, Artificial Sequence
  derived and/or modified CDS sequence (AUadapt) from InfluenzaA__AHL89330__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11453 - RNA, 1701 nt, Artificial Sequence; identical to SEQ ID NO: 875
  derived and/or modified CDS sequence (AUadapt) from InfluenzaA__AHL89342__HA

SEQ ID NO: 11454 - RNA, 1701 nt, Artificial Sequence; identical to SEQ ID NO: 1806
  derived and/or modified CDS sequence (AUadapt) from InfluenzaA__AHL89354__HA

SEQ ID NO: 11455 - RNA, 1701 nt, Artificial Sequence
  derived and/or modified CDS sequence (AUadapt) from InfluenzaA__AHL89366__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugaaguccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggaucggccaggccgccgaccugaaguccacccaggcggccaucaaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggaucgagcugaaguccggcuacaaggacuggauccuguggaucuccuucgccaucagcugcuuccuccugugcguggugcugcucggcuucaucaugugggccugccagaaggggaacauccgcugcaacaucugcaucuga

SEQ ID NO: 11456 - RNA, 1701 nt, Artificial Sequence; identical to SEQ ID NO: 11442
  derived and/or modified CDS sequence (AUadapt) from InfluenzaA__AHL89378__HA

SEQ ID NO: 11457 - RNA, 1701 nt, Artificial Sequence; identical to SEQ ID NO: 2073
  derived and/or modified CDS sequence (AUadapt) from InfluenzaA__AHL89390__HA

SEQ ID NO: 11458 - RNA, 1701 nt, Artificial Sequence; identical to SEQ ID NO: 11442
  derived and/or modified CDS sequence (AUadapt) from InfluenzaA__AHL89402__HA

SEQ ID NO: 11459 - RNA, 1701 nt, Artificial Sequence; identical to SEQ ID NO: 1826
  derived and/or modified CDS sequence (AUadapt) from InfluenzaA__AHL89414__HA

SEQ ID NO: 11460 - RNA, 1701 nt, Artificial Sequence
  derived and/or modified CDS sequence (AUadapt) from InfluenzaA__AHL89426__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccuguucaucaacuccaccgggaaccucaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccucaaguccacccaggcggccaucaaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacucggagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcgugguccugcugggcuucaucaugugggccugccagaaggggaacauccggugcaacaucugcaucuga

SEQ ID NO: 11461 - RNA, 1701 nt, Artificial Sequence; identical to SEQ ID NO: 11442
  derived and/or modified CDS sequence (AUadapt) from InfluenzaA__AHL89438__HA

SEQ ID NO: 11462 - RNA, 1701 nt, Artificial Sequence; identical to SEQ ID NO: 11442
  derived and/or modified CDS sequence (AUadapt) from InfluenzaA__AHL89450__HA

SEQ ID NO: 11463 - RNA, 1701 nt, Artificial Sequence; identical to SEQ ID NO: 11442
  derived and/or modified CDS sequence (AUadapt) from InfluenzaA__AHL89462__HA

SEQ ID NO: 11464 - RNA, 1701 nt, Artificial Sequence; identical to SEQ ID NO: 11442
  derived and/or modified CDS sequence (AUadapt) from InfluenzaA__AHL89474__HA

SEQ ID NO: 11465 - RNA, 1701 nt, Artificial Sequence; identical to SEQ ID NO: 2073
  derived and/or modified CDS sequence (AUadapt) from InfluenzaA__AHL89486__HA

SEQ ID NO: 11466 - RNA, 1701 nt, Artificial Sequence; identical to SEQ ID NO: 1826
  derived and/or modified CDS sequence (AUadapt) from InfluenzaA__AHL89498__HA

SEQ ID NO: 11467 - RNA, 1701 nt, Artificial Sequence; identical to SEQ ID NO: 1826
  derived and/or modified CDS sequence (AUadapt) from InfluenzaA__AHL89510__HA

SEQ ID NO: 11468 - RNA, 1701 nt, Artificial Sequence; identical to SEQ ID NO: 1826
  derived and/or modified CDS sequence (AUadapt) from InfluenzaA__AHL89522__HA

SEQ ID NO: 11469 - RNA, 1701 nt, Artificial Sequence
  derived and/or modified CDS sequence (AUadapt) from InfluenzaA__AHL89534__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcaagcgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggaucgagcugaaguccggcuacaaggacuggauccuguggaucuccuucgccaucagcugcuuccuccugugcguggugcugcucggcuucaucaugugggccugccagaaggggaacauccggugcaacaucugcaucuga

SEQ ID NO: 11470 - RNA, 1698 nt, Artificial Sequence
  derived and/or modified CDS sequence (AUadapt) from InfluenzaA__AHL89546__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagucggccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccucgcugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacucggaggaguccaagcucaaccgcgagcggaucgacggcgugaagcuggagagcaugggcgucuaccagauccuggccaucuacagcacgguggccuccagccucgugcugcuggucucccucggggccaucagcuucuggaugugcuccaacggcagccugcagugccgcaucugcaucuga

SEQ ID NO: 11471 - RNA, 1698 nt, Artificial Sequence; identical to SEQ ID NO: 2159
  derived and/or modified CDS sequence (AUadapt) from InfluenzaA__AHL89558__HA

SEQ ID NO: 11472 - RNA, 1698 nt, Artificial Sequence; identical to SEQ ID NO: 2159
  derived and/or modified CDS sequence (AUadapt) from InfluenzaA__AHL89570__HA

SEQ ID NO: 11473 - RNA, 1698 nt, Artificial Sequence; identical to SEQ ID NO: 2175
  derived and/or modified CDS sequence (AUadapt) from InfluenzaA__AHL89582__HA

SEQ ID NO: 11474 - RNA, 1698 nt, Artificial Sequence; identical to SEQ ID NO: 2175
  derived and/or modified CDS sequence (AUadapt) from InfluenzaA__AHL89594__HA

SEQ ID NO: 11475 - RNA, 1698 nt, Artificial Sequence; identical to SEQ ID NO: 2175
  derived and/or modified CDS sequence (AUadapt) from InfluenzaA__AHL89606__HA

SEQ ID NO: 11476 - RNA, 1698 nt, Artificial Sequence; identical to SEQ ID NO: 2159
  derived and/or modified CDS sequence (AUadapt) from InfluenzaA__AHL89618__HA

SEQ ID NO: 11477 - RNA, 1698 nt, Artificial Sequence; identical to SEQ ID NO: 2175
  derived and/or modified CDS sequence (AUadapt) from InfluenzaA__AHL89630__HA

SEQ ID NO: 11478 - RNA, 1698 nt, Artificial Sequence
  derived and/or modified CDS sequence (AUadapt) from InfluenzaA__AHL89642__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugucguccuucgagcgguucgagaucuucccgaaggagagcuccuggcccaaccacaccgucaccggggugagcgccuccugcagccacaacggcaaguccucguucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccaugggggagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcucgggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagucgaugggggucuaccagauccuggccaucuacuccacgguggccagcagccucgugcugcuggucucccucggcgccaucagcuucuggaugugcuccaacgggagccugcagugccggaucugcaucuga

SEQ ID NO: 11479 - RNA, 1698 nt, Artificial Sequence; identical to SEQ ID NO: 2190
  derived and/or modified CDS sequence (AUadapt) from InfluenzaA__AHL89654__HA

SEQ ID NO: 11480 - RNA, 1698 nt, Artificial Sequence
  derived and/or modified CDS sequence (AUadapt) from InfluenzaA__AHL89666__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugucguccuucgagcgguucgagaucuucccgaaggagagcuccuggcccaaccacaccgucaccggggugagcgccuccugcagccacaacggcaaguccucguucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucgcgcggguucggcuccggcaucaucacgagcaacgcccccaugggggagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcucgggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcggaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagucgaugggggucuaccagauccuggccaucuacuccacgguggccagcagccucgugcugcuggucucccucggcgccaucagcuucuggaugugcuccaacgggagccugcagugccggaucugcaucuga

SEQ ID NO: 11481 - RNA, 1698 nt, Artificial Sequence
  derived and/or modified CDS sequence (AUadapt) from InfluenzaA__AHL89678__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcucaaccgcaagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 11482 - RNA, 1698 nt, Artificial Sequence
  derived and/or modified CDS sequence (AUadapt) from InfluenzaA__AHL89690__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccgaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacucgucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 11483 - RNA, 1698 nt, Artificial Sequence; identical to SEQ ID NO: 2190
  derived and/or modified CDS sequence (AUadapt) from InfluenzaA__AHL89702__HA

SEQ ID NO: 11484 - RNA, 1698 nt, Artificial Sequence; identical to SEQ ID NO: 2159
  derived and/or modified CDS sequence (AUadapt) from InfluenzaA__AHL89714__HA

SEQ ID NO: 11485 - RNA, 1698 nt, Artificial Sequence
  derived and/or modified CDS sequence (AUadapt) from InfluenzaA__AHL89726__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugucggucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcucgaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagucgaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 11486 - RNA, 1698 nt, Artificial Sequence
  derived and/or modified CDS sequence (AUadapt) from InfluenzaA__AHL89750__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgggugcgacgcgaagugccagacgccccagggcgccaucaacagcucccugcccuuccagaacguccacccggugaccaucggggagugccccaaguacgugcggucgaccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagucgaagcucaaccgcgagaagaucgacggcgugaagcuggaguccaugggggucuaccagauccuggcgaucuacagcaccguggccagcucccucgugcugcuggucagccucggcgccaucuccuucuggaugugcagcaacgggucccugcagugccggaucugcaucuga

SEQ ID NO: 11487 - RNA, 1698 nt, Artificial Sequence; identical to SEQ ID NO: 2155
  derived and/or modified CDS sequence (AUadapt) from InfluenzaA__AHL89762__HA

SEQ ID NO: 11488 - RNA, 1698 nt, Artificial Sequence; identical to SEQ ID NO: 2201
  derived and/or modified CDS sequence (AUadapt) from InfluenzaA__AHL89774__HA

SEQ ID NO: 11489 - RNA, 1698 nt, Artificial Sequence; identical to SEQ ID NO: 2190
  derived and/or modified CDS sequence (AUadapt) from InfluenzaA__AHL89786__HA

SEQ ID NO: 11490 - RNA, 1698 nt, Artificial Sequence
  derived and/or modified CDS sequence (AUadapt) from InfluenzaA__AHL89798__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagucguccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccuccaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggucggccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 11491 - RNA, 1698 nt, Artificial Sequence
  derived and/or modified CDS sequence (AUadapt) from InfluenzaA__AHL89810__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccucguucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugucggucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcggagugccagacgccccagggcgccaucaacagcucccugcccuuccagaacguccacccggugaccaucggggagugccccaaguacgugcggucggccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagucgaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 11492 - RNA, 1698 nt, Artificial Sequence
  derived and/or modified CDS sequence (AUadapt) from InfluenzaA__AHL89822__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugucguccuucgagcgcuucgagaucuucccgaaggagagcuccuggcccaaccacaccgucaccggggugagcgccuccugcagccacaacggcaaguccucguucuaccggaaccugcuguggcucaccgggaagaacggccuguaccccaaccuguccaagagcuacgccaacaacaaggagaaggaggugcucguccuguggggcgugcaccacccgcccaacaucggggaccagcgcgcccuguaccacacggagaacgccuacguguccgucgugagcagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucgcggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagucgaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 11493 - RNA, 1698 nt, Artificial Sequence
  derived and/or modified CDS sequence (AUadapt) from InfluenzaA__AHL89834__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccucgguguccagcuucgagcgguucgagaucuucccgaaggaguccagcuggcccaaccacaccgucaccgggguguccgccagcugcucccacaacggcaagucguccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacucgcgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggggacggcugcuucgaguucuaccacaagugcaacgacgagugcauggagagcgugaagaacgggaccuacgacuaccccaaguacuccgaggagucgaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 11494 - RNA, 1698 nt, Artificial Sequence; identical to SEQ ID NO: 2201
  derived and/or modified CDS sequence (AUadapt) from InfluenzaA__AHL89846__HA

SEQ ID NO: 11495 - RNA, 1701 nt, Artificial Sequence; identical to SEQ ID NO: 2173
  derived and/or modified CDS sequence (AUadapt) from InfluenzaA__AHL89858__HA

SEQ ID NO: 11496 - RNA, 1701 nt, Artificial Sequence; identical to SEQ ID NO: 2173
  derived and/or modified CDS sequence (AUadapt) from InfluenzaA__AHL89870__HA

SEQ ID NO: 11497 - RNA, 1701 nt, Artificial Sequence
  derived and/or modified CDS sequence (AUadapt) from InfluenzaA__AHL89882__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcggcuccgacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucgggucgcgcccccggguccgcaacauccccucccggaucagcaucuacuggaccaucgugaagcccggcgacauccugcucaucaacuccaccgggaaccugaucgccccgcgcggcuacuucaagauccggucgggcaaguccucgaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggcuucaucgagaacgggugggagggcaugguggacgggugguacggcuuccggcaccagaacucggaggggaucggccaggccgccgaccugaaguccacccaggcggccaucaaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggccugccagaaggggaacauccgcugcaacaucugcaucuga

SEQ ID NO: 11498 - RNA, 1701 nt, Artificial Sequence; identical to SEQ ID NO: 2173
  derived and/or modified CDS sequence (AUadapt) from InfluenzaA__AHL89894__HA

SEQ ID NO: 11499 - RNA, 1701 nt, Artificial Sequence
  derived and/or modified CDS sequence (AUadapt) from InfluenzaA__AHL89906__HA
augaagaccaucaucgcccugucguacauccucugccugguguacgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacugggccggggugacccagaacggcaccuccucggccugcaagcgcggguccaacaacucguucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugucgaccaagcggagccagcagacggugaucccgaacaucggcucccgcccccggguccgcaacauccccucgcggaucuccaucuacuggaccaucgugaagcccggggacauccugcugaucaacagcaccggcaaccucaucgccccgcgcggguacuucaagauccgguccggcaagucguccaucaugcgcucggacgcccccaucggcaagugcaacuccgagugcaucacccccaacgggagcauccccaacgacaagccguuccagaacgugaaccggaucacguacggcgcgugcccccgcuacguccggcagaacacccugaagcuggccaccgggaugcgcaacgugcccgagaagcagacccggggcaucuucggggccaucgccggcuucaucgagaacggcugggaggggaugguggacggcugguacggguuccgccaccagaacuccgagggcaucgggcaggccgcggaccucaagucgacgcaggccgccaucgaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgggagaacgcggaggacaugggcaacgggugcuucaagaucuaccacaagugcgacaacgccugcaucggcucgauccgcaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcguggcccugcugggguucaucaugugggcgugccagaagggcaacauccgcugcaacaucugcaucuga

SEQ ID NO: 11500 - RNA, 1701 nt, Artificial Sequence
  derived and/or modified CDS sequence (AUadapt) from InfluenzaA__AHL89918__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaccuuccuguacgcgcaggccucggggcggaucacgguguccaccaagcgcagccagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccagucggggaaguccucgaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgcgacgggcaugcggaacgugcccgagaagcagacccgcgggaucuucggcgccaucgccggguucaucgagaacggcugggagggcaugguggacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11501 - RNA, 1701 nt, Artificial Sequence
  derived and/or modified CDS sequence (AUadapt) from InfluenzaA__AHL89930__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccucgaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgucgcugcggucccucgucgccagcuccgggacgcuggaguucaacaacgagucguucaacugggccggcgugacccagaacgggaccuccagcgccugcaagcgcggcuccaacaacucguucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugucgaccaagcggagccagcagacggugaucccgaacaucgggucccgcccccggguccgcaacauccccucgcggaucuccaucuacuggaccaucgugaagcccggcgacauccugcugaucaacagcaccgggaaccucaucgccccgcgcggcuacuucaagauccgguccggcaagucguccaucaugcgcagcgacgcccccaucuccaagugcaacucggagugcaucacccccaacggguccauccccaacgacaagccguuccagaacgugaaccggaucacguacggcgcgugcccccgcuacgucaagcagaacacccugaagcuggccaccgggaugcggaacgugcccgagaagcagacccgcggcaucuucggggccaucgccggcuucaucgagaacggcugggaggggaugguggacggcugguacggguuccggcaccagaacagcgagggcauggggcaggccgcggaccucaaguccacgcaggccgccaucgaccagaucaacggcaagcugaaccgccugaucggcaagaccaacgagaaguuccaccagaucgagaaggaguucucggaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagaagaccaagaagcagcuccgcgagaacgcggaggacaugggcaacgggugcuucaagaucuaccacaagugcgacaacgccugcaucggcuccauccggaacgggaccuacgaccacgacgucuaccgcgacgaggcccugaacaaccgcuuccagaucaagggcguggagcucaagucgggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 11502 - RNA, 1701 nt, Artificial Sequence; identical to SEQ ID NO: 2160
  derived and/or modified CDS sequence (AUadapt) from InfluenzaA__AHL89942__HA

SEQ ID NO: 11503 - RNA, 1701 nt, Artificial Sequence
  derived and/or modified CDS sequence (AUadapt) from InfluenzaA__AHL89954__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggaccacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 11504 - RNA, 1701 nt, Artificial Sequence; identical to SEQ ID NO: 2173
  derived and/or modified CDS sequence (AUadapt) from InfluenzaA__AHL89966__HA

SEQ ID NO: 11505 - RNA, 1701 nt, Artificial Sequence; identical to SEQ ID NO: 2173
  derived and/or modified CDS sequence (AUadapt) from InfluenzaA__AHL89978__HA

SEQ ID NO: 11506 - RNA, 1701 nt, Artificial Sequence; identical to SEQ ID NO: 2232
  derived and/or modified CDS sequence (AUadapt) from InfluenzaA__AHL89990__HA

SEQ ID NO: 11507 - RNA, 1701 nt, Artificial Sequence
  derived and/or modified CDS sequence (AUadapt) from InfluenzaA__AHL90002__HA
augaagaccaucaucgcccugucguacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccucguccgggacgcuggaguucaacaacgagagcuucaacugggccggcgugacccagaacgggaccuccucggccugcaagcgcggcuccaacaacagcuucuucucccggcugaacuggcucacccacucgaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugagcaccaagcggucgcagcagacggugaucccgaacaucgggucccgcccccggguccgcaacauccccagccggaucuccaucuacuggaccaucgugaagcccggcgacauccugcugaucaacucgaccgggaaccucaucgccccgcgcggcuacuucaagauccgguccggcaagagcuccaucaugcgcucggacgcccccaucgggaagugcaacuccgagugcaucacccccaacggcagcauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaugggccaggccgcggaccucaagucgacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggucgauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggcgugccagaaggggaacauccggugcaacaucugcaucuga

SEQ ID NO: 11508 - RNA, 1701 nt, Artificial Sequence
  derived and/or modified CDS sequence (AUadapt) from InfluenzaA__AHL90014__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagguggaggucacgaacgccaccgagcuggugcagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgucgcugcggucccucguggccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucuuccuguacgcgcaggccagcgggcggaucaccguguccacgaagcgcucgcagcagaccgucaucccgaacaucggcagccggccccgcgugcggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 11509 - RNA, 1701 nt, Artificial Sequence; identical to SEQ ID NO: 11508
  derived and/or modified CDS sequence (AUadapt) from InfluenzaA__AHL90026__HA

SEQ ID NO: 11510 - RNA, 1701 nt, Artificial Sequence
  derived and/or modified CDS sequence (AUadapt) from InfluenzaA__AHL90050__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacgccgagaugaacaagcuguucgagaagaccaagaagcagcugcgggagaacgcggaggacauggggaacggcugcuucaagaucuaccacaagugcgacaacgccugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 11511 - RNA, 1701 nt, Artificial Sequence
  derived and/or modified CDS sequence (AUadapt) from InfluenzaA__AHL90062__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccucgaccggcgagaucugcgacagcccccaccagauccucgacggggagaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggcgugacccagaacgggaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccggaucaccguguccacgaagcgcagccagcagaccgugaucccgaacaucgggucgcggccccgcguccggaacauccccucccgcaucagcaucuacuggaccaucgugaagcccggcgacauccugcucaucaacuccaccggcaaccugaucgccccgcggggguacuucaagauccgcucgggcaaguccagcaucaugcgguccgacgcccccaucgggaagugcaacucggagugcaucacgcccaacggcuccauccccaacuacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacgggugggagggcaugguggacggcugguacggguuccgccaccagaacagcgagggcaucgggcaggccgccgaccugaaguccacccaggcggccaucgaccagaucaacggcaagcugaaccggcucaucgggaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggccugccagaagggcaacauccgcugcaacaucugcaucuga

SEQ ID NO: 11512 - RNA, 1701 nt, Artificial Sequence; identical to SEQ ID NO: 2173
  derived and/or modified CDS sequence (AUadapt) from InfluenzaA__AHL90074__HA

SEQ ID NO: 11513 - RNA, 1701 nt, Artificial Sequence
  derived and/or modified CDS sequence (AUadapt) from InfluenzaA__AHL90086__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguacaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcagccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 11514 - RNA, 1701 nt, Artificial Sequence
  derived and/or modified CDS sequence (AUadapt) from InfluenzaA__AHL90098__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccucggccugcaagcgcggcuccgacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucgggccgcaucaccguguccacgaagcggagccagcagaccgugaucccgaacaucgggucgcgcccccggguccgcaacauccccucccggaucagcaucuacuggaccaucgugaagcccggcgacauccugcucaucaacuccaccgggaaccugaucgccccgcgcggcuacuucaagauccggucgggcaaguccucgaucaugcgcuccgacgcccccaucgacaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacucggagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacucggagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 11515 - RNA, 1701 nt, Artificial Sequence
  derived and/or modified CDS sequence (AUadapt) from InfluenzaA__AHL90110__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccagagcgggaaguccucggugaugcgcuccgacgcccccaucggcaagugcaacagcgagugcaucacgcccaacggcuccauccccaacgacaagccguuccagaacgucaaccggaucaccuacggggccugcccccgcuacgugaagcagaacacccugaagcucgcgaccggcaugcggaacgugcccgagaagcagacgcgcgggaucuucggcgccaucgccggguucaucgagaacggcugggagggcauggucgacgggugguacggcuuccggcaccagaacucggaggggaucggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 11516 - RNA, 1698 nt, Artificial Sequence; identical to SEQ ID NO: 4340
  derived and/or modified CDS sequence (AUadapt) from InfluenzaA__AHL90122__HA

SEQ ID NO: 11517 - RNA, 1698 nt, Artificial Sequence; identical to SEQ ID NO: 2733
  derived and/or modified CDS sequence (AUadapt) from InfluenzaA__AHL90133__HA

SEQ ID NO: 11518 - RNA, 1698 nt, Artificial Sequence; identical to SEQ ID NO: 4340
  derived and/or modified CDS sequence (AUadapt) from InfluenzaA__AHL90145__HA

SEQ ID NO: 11519 - RNA, 1698 nt, Artificial Sequence
  derived and/or modified CDS sequence (AUadapt) from InfluenzaA__AHL90157__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagauccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccaucgccucgagccuggugcuccuggugucccugggggccaucagcuucuggaugugcuccaacggcagccuccagugccggaucugcaucuga

SEQ ID NO: 11520 - RNA, 1698 nt, Artificial Sequence; identical to SEQ ID NO: 4340
  derived and/or modified CDS sequence (AUadapt) from InfluenzaA__AHL90169__HA

SEQ ID NO: 11521 - RNA, 1698 nt, Artificial Sequence
  derived and/or modified CDS sequence (AUadapt) from InfluenzaA__AHL90181__HA
augaaggugaagcugcucguccugcugugcaccuucgccgccaccuacgcggacacgaucugcaucggcuaccacgccaacaacucgaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccaagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacucggucaucgagaagaugaacacgcaguucaccgccguggggaaggaguucaacaagcuggagcggcgcauggagaaccucaacaagaaggucgacgacggcuucaucgacaucuggaccuacaacgcggagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 11522 - RNA, 1698 nt, Artificial Sequence; identical to SEQ ID NO: 3415
  derived and/or modified CDS sequence (AUadapt) from InfluenzaA__AHL90217__HA

SEQ ID NO: 11523 - RNA, 1698 nt, Artificial Sequence; identical to SEQ ID NO: 3415
  derived and/or modified CDS sequence (AUadapt) from InfluenzaA__AHL90229__HA

SEQ ID NO: 11524 - RNA, 1698 nt, Artificial Sequence
  derived and/or modified CDS sequence (AUadapt) from InfluenzaA__AHL90241__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugauccccaaggagagcugguccuacaucguggagaagcccaaccccgagaacgggaccugcuacccgggccacuucgccgacuacgaggagcugcgcgagcagcucucguccgugagcuccuucgagcgguucgagaucuuccccaaggagagcuccuggcccaaccacacggucaccggggugucggccuccugcagccacaacggcgaguccagcuucuaccgcaaccugcuguggcucaccgggaagaacggccuguaccccaaccuguccaagucguacgccaacaacaaggagaaggaggugcucguccuguggggcgugcaccacccgcccaacaucggcgaccagaaggcccuguaccacaccgagaacgccuacguguccgucgugagcagccacuacucccggaaguucacgcccgagaucgccaagcgccccaaggugcgggaccaggagggccgcaucaacuacuacuggacccuccuggagccgggggacaccaucaucuucgaggcgaacggcaaccugaucgcgccccgguacgccuucgcccucucgcgcggguucggcuccggcaucaucaacagcaacgcccccauggacaagugcgacgccaagugccagacgccccagggggccaucaacuccagccugccguuccagaacguccaccccgugaccaucggcgagugccccaaguacgugcgguccgccaagcugcgcauggucaccgggcuccggaacauccccucgauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuacccgaaguacagcgaggaguccaagcugaaccgcgagaagaucgacggcgugaagcucgagagcaugggcgucuaccagauccuggccaucuacuccaccguggccucgagccuggugcuccuggucucccugggggccaucagcuucuggaugugcuccaacggcagccuccagugccggaucugcaucuga

SEQ ID NO: 11525 - RNA, 1698 nt, Artificial Sequence
  derived and/or modified CDS sequence (AUadapt) from InfluenzaA__AHL90253__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaagggguccagcuggcccaaccacacggucaccggcguguccgccagcugcucccacaacggggagucguccuucuaccgcaaccugcuguggcucaccggcaagaacgggcuguaccccaaccugagcaaguccuacgccaacaacaaggagaaggaggugcucguccuguggggcgugcaccacccgcccaacaucggcgaccagaagacccuguaccacacggagaacgccuacgugagcgucgugagcucccacuacucgcggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagucgcgcgggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggugucgaagcugaaccgcgagaagaucgacggcgucaagcucgaguccauggggguguaccagauccuggcgaucuacagcaccguggccagcucccugguccuccuggugagccugggcgccaucuccuucuggaugugcagcaacgggucccuccagugccggaucugcaucuga

SEQ ID NO: 11526 - RNA, 1698 nt, Artificial Sequence; identical to SEQ ID NO: 2733
  derived and/or modified CDS sequence (AUadapt) from InfluenzaA__AHL90265__HA

SEQ ID NO: 11527 - RNA, 1698 nt, Artificial Sequence
  derived and/or modified CDS sequence (AUadapt) from InfluenzaA__AHL90277__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccacacggagaacgccuacgucagcguggugagcucccacuacucgcggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagucgcgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgcgagaagaucgacggggucaagcucgaguccaugggcguguaccagauccuggcgaucuacagcaccguggccagcucccugguccuccuggugagccugggcgccaucuccuucuggaugugcagcaacgggucccuccagugccggaucugcaucuga

SEQ ID NO: 11528 - RNA, 1698 nt, Artificial Sequence
  derived and/or modified CDS sequence (AUadapt) from InfluenzaA__AHL90289__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagccccgggacaccaucaucuucgaggcgaacgggaaccugaucgccccgcgcuacgccuucgcccucucccggggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacucggucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgggagaagaucgacggggugaagcucgaguccaugggcgucuaccagauccuggccaucuacucgaccguggccagcucccuggugcuccuggucagccugggcgccaucuccuucuggaugugcagcaacgggucccuccagugccgcaucugcaucuga

SEQ ID NO: 11529 - RNA, 1698 nt, Artificial Sequence; identical to SEQ ID NO: 11528
  derived and/or modified CDS sequence (AUadapt) from InfluenzaA__AHL90301__HA

SEQ ID NO: 11530 - RNA, 1698 nt, Artificial Sequence
  derived and/or modified CDS sequence (AUadapt) from InfluenzaA__AHL90325__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacucggucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagauggggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacucgaccguggccagcucccuggugcuccuggucagccugggggccaucuccuucuggaugugcagcaacggcucccuccagugccggaucugcaucuga

SEQ ID NO: 11531 - RNA, 1698 nt, Artificial Sequence; identical to SEQ ID NO: 11530
  derived and/or modified CDS sequence (AUadapt) from InfluenzaA__AHL90337__HA

SEQ ID NO: 11532 - RNA, 1698 nt, Artificial Sequence; identical to SEQ ID NO: 2733
  derived and/or modified CDS sequence (AUadapt) from InfluenzaA__AHL90349__HA

SEQ ID NO: 11533 - RNA, 1698 nt, Artificial Sequence; identical to SEQ ID NO: 2733
  derived and/or modified CDS sequence (AUadapt) from InfluenzaA__AHL90361__HA

SEQ ID NO: 11534 - RNA, 1698 nt, Artificial Sequence; identical to SEQ ID NO: 11527
  derived and/or modified CDS sequence (AUadapt) from InfluenzaA__AHL90373__HA

SEQ ID NO: 11535 - RNA, 1701 nt, Artificial Sequence
  derived and/or modified CDS sequence (AUadapt) from InfluenzaA__AHL90385__HA
augaagaccaucaucgcccugucguacauccagugccucguguucgcccagaaguuccccggcaacgacaacuccaccgcgacgcugugccuggggcaccacgccgucccgaacggcaccaucgugaagaccaucaccaacgaccagaucgaggugacgaacgccaccgagcucguccagucguccagcaccggggagaucugcgacucgccccaccagauccuggacggcgagaacugcacccugaucgacgcccuccugggggacccccagugcgacggcuuccagaacaagaacugggaccuguucguggagcgcagcaaggccuacuccaacugcuaccccuacgacgugccggacuacgcgucgcuccggucccuggucgccagcuccggcacgcuggaguucaacaacgagucguucaacuggaccggggugacccagaacggcaccuccagcgccugcauccgccgguccaacaacucguucuucucccgccucaacuggcugacgcacagcaaguucaaguaccccgcccugaacgugaccaugcccaacaacgagaacuucgacaagcucuacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagucgacccaggcggccaucgaccagaucaacgggaagcugaaccggcugaucggccgcaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 11536 - RNA, 1701 nt, Artificial Sequence
  derived and/or modified CDS sequence (AUadapt) from InfluenzaA__AHL90397__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcagcuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 11537 - RNA, 1701 nt, Artificial Sequence; identical to SEQ ID NO: 2679
  derived and/or modified CDS sequence (AUadapt) from InfluenzaA__AHL90410__HA

SEQ ID NO: 11538 - RNA, 1701 nt, Artificial Sequence
  derived and/or modified CDS sequence (AUadapt) from InfluenzaA__AHL90422__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcacucgaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcugaucaacucgaccgggaaccucaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggucguacaacgccgagcugcucguggcccuggagaaccagcacacgaucgaccugaccgacuccgagaugagcaagcuguucgagaagaccaagaagcagcuccgggagaacgccgaggacauggggaacggcugcuucaagaucuaccacaagugcgacaacacgugcaucggguccauccgcaacggcaccuacgaccacaacgucuaccgcgacgaggcgcugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 11539 - RNA, 1701 nt, Artificial Sequence; identical to SEQ ID NO: 2679
  derived and/or modified CDS sequence (AUadapt) from InfluenzaA__AHL90434__HA

SEQ ID NO: 11540 - RNA, 1701 nt, Artificial Sequence; identical to SEQ ID NO: 2679
  derived and/or modified CDS sequence (AUadapt) from InfluenzaA__AHL90446__HA

SEQ ID NO: 11541 - RNA, 1701 nt, Artificial Sequence
  derived and/or modified CDS sequence (AUadapt) from InfluenzaA__AHL90458__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcgcccugaucgacgcccugcucggggacccccagugcgacggcuuccagaacaagaagugggaccuguucguggagcgcagcaaggcguacuccaacugcuaccccuacgacgugccggacuacgccucgcugcggucccucgucgccagcuccggcacccuggaguucaacaacgagucguucaacuggacgggggugacccagaacggcaccuccucggccugcauccgccgguccaacaacagcuucuucucccgccugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 11542 - RNA, 1701 nt, Artificial Sequence; identical to SEQ ID NO: 2679
  derived and/or modified CDS sequence (AUadapt) from InfluenzaA__AHL90470__HA

SEQ ID NO: 11543 - RNA, 1701 nt, Artificial Sequence; identical to SEQ ID NO: 2679
  derived and/or modified CDS sequence (AUadapt) from InfluenzaA__AHL90482__HA

SEQ ID NO: 11544 - RNA, 1701 nt, Artificial Sequence; identical to SEQ ID NO: 2782
  derived and/or modified CDS sequence (AUadapt) from InfluenzaA__AHL90494__HA

SEQ ID NO: 11545 - RNA, 1701 nt, Artificial Sequence; identical to SEQ ID NO: 2782
  derived and/or modified CDS sequence (AUadapt) from InfluenzaA__AHL90506__HA

SEQ ID NO: 11546 - RNA, 1701 nt, Artificial Sequence
  derived and/or modified CDS sequence (AUadapt) from InfluenzaA__AHL90518__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaagaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaaggagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 11547 - RNA, 1701 nt, Artificial Sequence; identical to SEQ ID NO: 3458
  derived and/or modified CDS sequence (AUadapt) from InfluenzaA__AHL90530__HA

SEQ ID NO: 11548 - RNA, 1701 nt, Artificial Sequence; identical to SEQ ID NO: 2679
  derived and/or modified CDS sequence (AUadapt) from InfluenzaA__AHL90542__HA

SEQ ID NO: 11549 - RNA, 1701 nt, Artificial Sequence; identical to SEQ ID NO: 2679
  derived and/or modified CDS sequence (AUadapt) from InfluenzaA__AHL90554__HA

SEQ ID NO: 11550 - RNA, 1701 nt, Artificial Sequence; identical to SEQ ID NO: 2679
  derived and/or modified CDS sequence (AUadapt) from InfluenzaA__AHL90566__HA

SEQ ID NO: 11551 - RNA, 1701 nt, Artificial Sequence; identical to SEQ ID NO: 2679
  derived and/or modified CDS sequence (AUadapt) from InfluenzaA__AHL90578__HA

SEQ ID NO: 11552 - RNA, 1701 nt, Artificial Sequence; identical to SEQ ID NO: 2782
  derived and/or modified CDS sequence (AUadapt) from InfluenzaA__AHL90590__HA

SEQ ID NO: 11553 - RNA, 1701 nt, Artificial Sequence; identical to SEQ ID NO: 2679
  derived and/or modified CDS sequence (AUadapt) from InfluenzaA__AHL90602__HA

SEQ ID NO: 11554 - RNA, 1701 nt, Artificial Sequence; identical to SEQ ID NO: 2679
  derived and/or modified CDS sequence (AUadapt) from InfluenzaA__AHL90614__HA

SEQ ID NO: 11555 - RNA, 1701 nt, Artificial Sequence
  derived and/or modified CDS sequence (AUadapt) from InfluenzaA__AHL90638__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucgcggaaguccucgaucaugcgcuccgacgcccccaucgggaagugcaacagcgagugcaucacgcccaacggcuccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacgggugggagggcaugguggacggcugguacggguuccggcaccagaacucggagggccgcgggcaggccgccgaccugaaguccacccaggcggccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggccugccagaagggcaacauccgcugcaacaucugcaucuga

SEQ ID NO: 11556 - RNA, 1701 nt, Artificial Sequence
  derived and/or modified CDS sequence (AUadapt) from InfluenzaA__AHL90650__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaccuuccuguacgcgcaggccagcgggcggaucacgguguccaccaagcgcucgcagcagaccgugaucccgaacaucggcucgcggccccgcguccggaacauccccucccgcaucagcaucuacuggaccaucgugaagcccggcgacauccugcucaucaacuccacggggaaccugaucgccccgcggggcuacuucaagauccgcucggggaaguccagcaucaugcgguccgacgcccccaucggcaagugcaacucggagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11557 - RNA, 1701 nt, Artificial Sequence; identical to SEQ ID NO: 2679
  derived and/or modified CDS sequence (AUadapt) from InfluenzaA__AHL90662__HA

SEQ ID NO: 11558 - RNA, 1701 nt, Artificial Sequence
  derived and/or modified CDS sequence (AUadapt) from InfluenzaA__AHL90674__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgucugcaucggguccauccgcaacggcaccuacgaccacgacguguaccgcgacgaggcgcucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 11559 - RNA, 1701 nt, Artificial Sequence
  derived and/or modified CDS sequence (AUadapt) from InfluenzaA__AHL90686__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucucggaggucgagggccggauccaggaccuggagaaguacguggaggacaccaagaucgaccugugguccuacaacgccgagcuccugguggccauggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagucgggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 11560 - RNA, 1701 nt, Artificial Sequence; identical to SEQ ID NO: 2679
  derived and/or modified CDS sequence (AUadapt) from InfluenzaA__AHL90698__HA

SEQ ID NO: 11561 - RNA, 1701 nt, Artificial Sequence; identical to SEQ ID NO: 2679
  derived and/or modified CDS sequence (AUadapt) from InfluenzaA__AHL90710__HA

SEQ ID NO: 11562 - RNA, 1698 nt, Artificial Sequence; identical to SEQ ID NO: 6217
  derived and/or modified CDS sequence (AUadapt) from InfluenzaA__AHL90722__HA

SEQ ID NO: 11563 - RNA, 1698 nt, Artificial Sequence
  derived and/or modified CDS sequence (AUadapt) from InfluenzaA__AHL90746__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucaagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccaugggcaagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagucgcggggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggucaacagcgugaucgagaagaugaacacccaguucaccgccgucgggaaggaguucaacaagcuggagcgccggauggagaaccucaacaagaagguggacgacggcuucaucgacaucuggacguacaacgccgagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagucgaagcugaaccgggagaagaucgacggcgucaagcucgaguccaugggcguguaccagauccuggcgaucuacagcaccguggccagcucccugguccuccuggugagccugggggccaucuccuucuggaugugcagcaacggcucccuccagugccgcaucugcaucuga

SEQ ID NO: 11564 - RNA, 1698 nt, Artificial Sequence; identical to SEQ ID NO: 3376
  derived and/or modified CDS sequence (AUadapt) from InfluenzaA__AHL90758__HA

SEQ ID NO: 11565 - RNA, 1698 nt, Artificial Sequence
  derived and/or modified CDS sequence (AUadapt) from InfluenzaA__AHL90770__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggacuccucguggcccaaccacacggucaccgggguguccgccagcugcucccacaacggcgagagcuccuucuaccgcaaccugcuguggcucaccgggaagaacggccuguaccccaaccugucgaaguccuacgccaacaacaaggagaaggaggugcucguccuguggggcgugcaccacccgcccagcaucaacgaccagaagacccuguaccacacggagaacgccuacgugagcgucguguccagccaccacucccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucgcgcggcuucggguccggcaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccucgauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagucgcagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccugaccaucuacucgacgguggcguccagccuggugcuccuggucucccugggcgccaucagcuucuggaugugcuccaacgggagccuccagugccggaucugcaucuga

SEQ ID NO: 11566 - RNA, 1698 nt, Artificial Sequence; identical to SEQ ID NO: 3861
  derived and/or modified CDS sequence (AUadapt) from InfluenzaA__AHL90782__HA

SEQ ID NO: 11567 - RNA, 1698 nt, Artificial Sequence
  derived and/or modified CDS sequence (AUadapt) from InfluenzaA__AHL90794__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaacacccuguaccacacggagaacgccuacgugucggucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacucggucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacucgaccguggccagcucccuggugcuccuggucagccugggggccaucuccuucuggaugugcagcaacggcucccuccagugccggaucugcaucuga

SEQ ID NO: 11568 - RNA, 1698 nt, Artificial Sequence
  derived and/or modified CDS sequence (AUadapt) from InfluenzaA__AHL90806__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacucgcgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagucgcgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagucgaagcugaaccgggagaagaucgacggggucaagcucgaguccaugggcguguaccagauccuggcgaucuacagcaccguggccagcucccugguccuccugaucagccugggcgccaucuccuucuggaugugcagcaacgggucccuccagugccgcaucugcaucuga

SEQ ID NO: 11569 - RNA, 1698 nt, Artificial Sequence; identical to SEQ ID NO: 6217
  derived and/or modified CDS sequence (AUadapt) from InfluenzaA__AHL90818__HA

SEQ ID NO: 11570 - RNA, 1698 nt, Artificial Sequence; identical to SEQ ID NO: 6217
  derived and/or modified CDS sequence (AUadapt) from InfluenzaA__AHL90830__HA

SEQ ID NO: 11571 - RNA, 1698 nt, Artificial Sequence; identical to SEQ ID NO: 3376
  derived and/or modified CDS sequence (AUadapt) from InfluenzaA__AHL90842__HA

SEQ ID NO: 11572 - RNA, 1698 nt, Artificial Sequence; identical to SEQ ID NO: 5758
  derived and/or modified CDS sequence (AUadapt) from InfluenzaA__AHL90854__HA

SEQ ID NO: 11573 - RNA, 1698 nt, Artificial Sequence; identical to SEQ ID NO: 3376
  derived and/or modified CDS sequence (AUadapt) from InfluenzaA__AHL90866__HA

SEQ ID NO: 11574 - RNA, 1698 nt, Artificial Sequence; identical to SEQ ID NO: 5758
  derived and/or modified CDS sequence (AUadapt) from InfluenzaA__AHL90878__HA

SEQ ID NO: 11575 - RNA, 1698 nt, Artificial Sequence; identical to SEQ ID NO: 6217
  derived and/or modified CDS sequence (AUadapt) from InfluenzaA__AHL90890__HA

SEQ ID NO: 11576 - RNA, 1698 nt, Artificial Sequence; identical to SEQ ID NO: 5758
  derived and/or modified CDS sequence (AUadapt) from InfluenzaA__AHL90902__HA

SEQ ID NO: 11577 - RNA, 1698 nt, Artificial Sequence; identical to SEQ ID NO: 3376
  derived and/or modified CDS sequence (AUadapt) from InfluenzaA__AHL90914__HA

SEQ ID NO: 11578 - RNA, 1698 nt, Artificial Sequence; identical to SEQ ID NO: 5758
  derived and/or modified CDS sequence (AUadapt) from InfluenzaA__AHL90938__HA

SEQ ID NO: 11579 - RNA, 1698 nt, Artificial Sequence; identical to SEQ ID NO: 5758
  derived and/or modified CDS sequence (AUadapt) from InfluenzaA__AHL90950__HA

SEQ ID NO: 11580 - RNA, 1698 nt, Artificial Sequence; identical to SEQ ID NO: 5758
  derived and/or modified CDS sequence (AUadapt) from InfluenzaA__AHL90962__HA

SEQ ID NO: 11581 - RNA, 1698 nt, Artificial Sequence
  derived and/or modified CDS sequence (AUadapt) from InfluenzaA__AHL90974__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucucggaccagaagacccuguaccacacggagaacgccuacguguccgucgugagcucccacuacagccggaaguucacccccgagguggccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggucgggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacucggugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagggccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgucaagcucgagagcaugggcguguaccagauccuggcgaucuacucgaccguggccuccagccugguccuccuggugucccugggggccaucagcuucuggaugugcuccaacggcagccuccagugccggaucugcaucuga

SEQ ID NO: 11582 - RNA, 1698 nt, Artificial Sequence
  derived and/or modified CDS sequence (AUadapt) from InfluenzaA__AHL90986__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugucgguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucuccaagggguucggcagcgggaucaucaacuccaacgcccccauggacaagugcgacgccaagugccagacgccccggggcgcgaucaacagcucccugcccuuccagaacgugcacccggucaccaucggcgagugccccaaguacgugcgcucggccaagcugcggauggugaccgggcuccgcaacauccccuccauccagagccggggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaagguggacgacggcuucaucgacaucuggacguacaacgccgagcugcugguccuccuggagaacgagcgcacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagucgaagcugaaccgggagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccgcaucugcaucuga

SEQ ID NO: 11583 - RNA, 1698 nt, Artificial Sequence
  derived and/or modified CDS sequence (AUadapt) from InfluenzaA__AHL91010__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggacuccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucaacgaccagaagacccuguaccacacggagaacgccuacgugucggucguguccagccacuacucccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucagccgcggcuucggguccggcaucaucaacucgaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgccgcggaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccugaccaucuacucgacgguggcguccagccuggugcuccuggucucccugggcgccaucagcuucuggaugugcuccaacgggagccuccagugccggaucugcaucuga

SEQ ID NO: 11584 - RNA, 1698 nt, Artificial Sequence
  derived and/or modified CDS sequence (AUadapt) from InfluenzaA__AHL91022__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggacuccagcuggcccaaccacacggucaccgggguguccgccucgugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccuccaucaacgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccugaccaucuacucgacgguggcgagcucccuggugcuccuggucagccugggcgccaucuccuucuggaugugcagcaacgggucccuccagugccggaucugcaucuga

SEQ ID NO: 11585 - RNA, 1701 nt, Artificial Sequence; identical to SEQ ID NO: 2679
  derived and/or modified CDS sequence (AUadapt) from InfluenzaA__AHL91034__HA

SEQ ID NO: 11586 - RNA, 1701 nt, Artificial Sequence; identical to SEQ ID NO: 5745
  derived and/or modified CDS sequence (AUadapt) from InfluenzaA__AHL91046__HA

SEQ ID NO: 11587 - RNA, 1701 nt, Artificial Sequence; identical to SEQ ID NO: 11559
  derived and/or modified CDS sequence (AUadapt) from InfluenzaA__AHL91058__HA

SEQ ID NO: 11588 - RNA, 1701 nt, Artificial Sequence
  derived and/or modified CDS sequence (AUadapt) from InfluenzaA__AHL91070__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccagaucgaggugaccaacgccacggagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggacgggggugacccagaacggcaccuccagcgccugcaugcgccgguccaacaacucguucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccagcgggcggaucaccguguccaccaagcgcucgcagcagacggugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11589 - RNA, 1701 nt, Artificial Sequence
  derived and/or modified CDS sequence (AUadapt) from InfluenzaA__AHL91082__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugccccaucuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 11590 - RNA, 1701 nt, Artificial Sequence; identical to SEQ ID NO: 5664
  derived and/or modified CDS sequence (AUadapt) from InfluenzaA__AHL91094__HA

SEQ ID NO: 11591 - RNA, 1701 nt, Artificial Sequence
  derived and/or modified CDS sequence (AUadapt) from InfluenzaA__AHL91106__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaagggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacccuggaguucaacaacgagucguucaacuggacgggggugacccagaacggcaccuccucggccugcauccgccgguccaacaacagcuucuucucccgccugaacuggcucacccaccugaaguucaaguaccccgcccugaacgugacgaugcccaacaacgagcaguucgacaagcucuacaucuggggcguccaccaccccgggaccgacaacgaccagaucuuccuguacgcgcaggccucggggcggaucaccguguccaccaagcgcagccagcagacggugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacccccaacggcuccauccccaacgacaagccguuccagaacgugaaccgcaucacguacggggccugcccccgguacgucaagcagaacacccugaagcucgcgaccggcaugcgcaacgugcccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11592 - RNA, 1701 nt, Artificial Sequence
  derived and/or modified CDS sequence (AUadapt) from InfluenzaA__AHL91118__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucuccaagcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcgcaucaccguguccacgaagcggagccagcagaccgugaucccgaacaucggcucgcgcccccggguccgcaacauccccucccggaucagcaucuacuggaccaucgugaagcccggcgacauccugcucaucaacuccaccgggaaccugaucgccccgcgcggcuacuucaagauccggucggggaaguccucgaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccuggugacgcuggagaaccagcacaccaucgaccucaccgacucggagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 11593 - RNA, 1701 nt, Artificial Sequence
  derived and/or modified CDS sequence (AUadapt) from InfluenzaA__AHL91130__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucaucgccagcuccggcacgcuggaguucaacaacgagucguucaacuggaccggggucacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcgcaggccucggggcggaucaccgucuccacgaagcgcagccagcagaccgugaucccgaacaucggcucgcggccccgcgugcggaacauccccucccgcaucagcaucuacuggaccaucgucaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 11594 - RNA, 1701 nt, Artificial Sequence; identical to SEQ ID NO: 2679
  derived and/or modified CDS sequence (AUadapt) from InfluenzaA__AHL91142__HA

SEQ ID NO: 11595 - RNA, 1701 nt, Artificial Sequence; identical to SEQ ID NO: 2679
  derived and/or modified CDS sequence (AUadapt) from InfluenzaA__AHL91154__HA

SEQ ID NO: 11596 - RNA, 1701 nt, Artificial Sequence; identical to SEQ ID NO: 875
  derived and/or modified CDS sequence (AUadapt) from InfluenzaA__AHL91166__HA

SEQ ID NO: 11597 - RNA, 1701 nt, Artificial Sequence; identical to SEQ ID NO: 10712
  derived and/or modified CDS sequence (AUadapt) from InfluenzaA__AHL94984__HA

SEQ ID NO: 11598 - RNA, 1701 nt, Artificial Sequence; identical to SEQ ID NO: 10712
  derived and/or modified CDS sequence (AUadapt) from InfluenzaA__AHL94996__HA

SEQ ID NO: 11599 - RNA, 1701 nt, Artificial Sequence; identical to SEQ ID NO: 10080
  derived and/or modified CDS sequence (AUadapt) from InfluenzaA__AHL95008__HA

SEQ ID NO: 11600 - RNA, 1701 nt, Artificial Sequence; identical to SEQ ID NO: 10242
  derived and/or modified CDS sequence (AUadapt) from InfluenzaA__AHL95020__HA

SEQ ID NO: 11601 - RNA, 1701 nt, Artificial Sequence; identical to SEQ ID NO: 162
  derived and/or modified CDS sequence (AUadapt) from InfluenzaA__AHL95032__HA

SEQ ID NO: 11602 - RNA, 1701 nt, Artificial Sequence; identical to SEQ ID NO: 10113
  derived and/or modified CDS sequence (AUadapt) from InfluenzaA__AHL95044__HA

SEQ ID NO: 11603 - RNA, 1701 nt, Artificial Sequence; identical to SEQ ID NO: 10103
  derived and/or modified CDS sequence (AUadapt) from InfluenzaA__AHL95056__HA

SEQ ID NO: 11604 - RNA, 1701 nt, Artificial Sequence; identical to SEQ ID NO: 10242
  derived and/or modified CDS sequence (AUadapt) from InfluenzaA__AHL95068__HA

SEQ ID NO: 11605 - RNA, 1701 nt, Artificial Sequence; identical to SEQ ID NO: 10790
  derived and/or modified CDS sequence (AUadapt) from InfluenzaA__AHL95080__HA

SEQ ID NO: 11606 - RNA, 1701 nt, Artificial Sequence; identical to SEQ ID NO: 10113
  derived and/or modified CDS sequence (AUadapt) from InfluenzaA__AHL95092__HA

SEQ ID NO: 11607 - RNA, 1701 nt, Artificial Sequence
  derived and/or modified CDS sequence (AUadapt) from InfluenzaA__AHL95104__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcaugcgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11608 - RNA, 1701 nt, Artificial Sequence
  derived and/or modified CDS sequence (AUadapt) from InfluenzaA__AHL95116__HA
augaagaccaucaucgcccugucguacauccucugccugguguucgcccaggagcugcccggcaacgacgacuccaccgcgacgcucugccuggggcacuacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgaaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11609 - RNA, 1701 nt, Artificial Sequence; identical to SEQ ID NO: 10080
  derived and/or modified CDS sequence (AUadapt) from InfluenzaA__AHL95128__HA

SEQ ID NO: 11610 - RNA, 1701 nt, Artificial Sequence; identical to SEQ ID NO: 10103
  derived and/or modified CDS sequence (AUadapt) from InfluenzaA__AHL95140__HA

SEQ ID NO: 11611 - RNA, 1701 nt, Artificial Sequence; identical to SEQ ID NO: 10113
  derived and/or modified CDS sequence (AUadapt) from InfluenzaA__AHL95152__HA

SEQ ID NO: 11612 - RNA, 1701 nt, Artificial Sequence; identical to SEQ ID NO: 10080
  derived and/or modified CDS sequence (AUadapt) from InfluenzaA__AHL95164__HA

SEQ ID NO: 11613 - RNA, 1701 nt, Artificial Sequence; identical to SEQ ID NO: 10113
  derived and/or modified CDS sequence (AUadapt) from InfluenzaA__AHL95176__HA

SEQ ID NO: 11614 - RNA, 1701 nt, Artificial Sequence; identical to SEQ ID NO: 10113
  derived and/or modified CDS sequence (AUadapt) from InfluenzaA__AHL95188__HA

SEQ ID NO: 11615 - RNA, 1701 nt, Artificial Sequence; identical to SEQ ID NO: 162
  derived and/or modified CDS sequence (AUadapt) from InfluenzaA__AHL95200__HA

SEQ ID NO: 11616 - RNA, 1701 nt, Artificial Sequence; identical to SEQ ID NO: 10113
  derived and/or modified CDS sequence (AUadapt) from InfluenzaA__AHL95212__HA

SEQ ID NO: 11617 - RNA, 1701 nt, Artificial Sequence; identical to SEQ ID NO: 10103
  derived and/or modified CDS sequence (AUadapt) from InfluenzaA__AHL95224__HA

SEQ ID NO: 11618 - RNA, 1701 nt, Artificial Sequence; identical to SEQ ID NO: 10103
  derived and/or modified CDS sequence (AUadapt) from InfluenzaA__AHL95236__HA

SEQ ID NO: 11619 - RNA, 1701 nt, Artificial Sequence; identical to SEQ ID NO: 10128
  derived and/or modified CDS sequence (AUadapt) from InfluenzaA__AHL95248__HA

SEQ ID NO: 11620 - RNA, 1701 nt, Artificial Sequence
  derived and/or modified CDS sequence (AUadapt) from InfluenzaA__AHL95260__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucucggagaucugcgacagcccccaccagauccucgacggggagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacaacgagagcuucaacugggccggcgugacgcagaacgggaccuccagcgccugcauccggggcuccaacucguccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccucggggcggaucaccgugagcaccaagcgcucccagcaggccgugaucccgaacaucggcucgcggccccgcauccggaacauccccucccgcaucagcaucuacuggaccaucgucaagcccggcgacauccugcucaucaacuccacggggaaccugaucgccccgcggggcuacuucaagauccgcagcgggaaguccucgaucaugcgguccgacgcccccaucggcaagugcaagagcgagugcaucacccccaacggcuccauccccaacgacaagccguuccagaacgugaaccgcaucaccuacggggcgugcccccgguacgugaagcagucgacccugaagcucgccacgggcaugcgcaacguccccgagaagcagacccgggggaucuucggcgccaucgccggguucaucgagaacggcugggagggcaugguggacgggugguacggcuuccgccaccagaacuccgaggggcggggccaggccgcggaccugaaguccacccaggccgccaucgaccagaucaacgggaagcugaaccgccucaucggcaagaccaacgagaaguuccaccagaucgagaaggaguucuccgagguggagggccggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccgcaacggcacguacgaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggcgugccagaaggggaacauccggugcaacaucugcaucuga

SEQ ID NO: 11621 - RNA, 1701 nt, Artificial Sequence; identical to SEQ ID NO: 10113
  derived and/or modified CDS sequence (AUadapt) from InfluenzaA__AHL95272__HA

SEQ ID NO: 11622 - RNA, 1701 nt, Artificial Sequence; identical to SEQ ID NO: 162
  derived and/or modified CDS sequence (AUadapt) from InfluenzaA__AHL95284__HA

SEQ ID NO: 11623 - RNA, 1701 nt, Artificial Sequence
  derived and/or modified CDS sequence (AUadapt) from InfluenzaA__AHL95296__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagauguuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaaggacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 11624 - RNA, 1701 nt, Artificial Sequence; identical to SEQ ID NO: 10080
  derived and/or modified CDS sequence (AUadapt) from InfluenzaA__AHL95307__HA

SEQ ID NO: 11625 - RNA, 1701 nt, Artificial Sequence; identical to SEQ ID NO: 10103
  derived and/or modified CDS sequence (AUadapt) from InfluenzaA__AHL95319__HA

SEQ ID NO: 11626 - RNA, 1701 nt, Artificial Sequence
  derived and/or modified CDS sequence (AUadapt) from InfluenzaA__AHL95331__HA
augaagaccaucaucgcccugucguacauccucugccugguguucgcccagaagcugcccggcgacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11627 - RNA, 1701 nt, Artificial Sequence
  derived and/or modified CDS sequence (AUadapt) from InfluenzaA__AHL95343__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagauccggggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 11628 - RNA, 1701 nt, Artificial Sequence; identical to SEQ ID NO: 10103
  derived and/or modified CDS sequence (AUadapt) from InfluenzaA__AHL95432__HA

SEQ ID NO: 11629 - RNA, 1701 nt, Artificial Sequence; identical to SEQ ID NO: 162
  derived and/or modified CDS sequence (AUadapt) from InfluenzaA__AHL95444__HA

SEQ ID NO: 11630 - RNA, 1701 nt, Artificial Sequence; identical to SEQ ID NO: 10103
  derived and/or modified CDS sequence (AUadapt) from InfluenzaA__AHL95457__HA

SEQ ID NO: 11631 - RNA, 1701 nt, Artificial Sequence
  derived and/or modified CDS sequence (AUadapt) from InfluenzaA__AHL95470__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugaagcagaacggcaccuccucggccugcauccgccgguccaacagcuccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccgugucgaccaagcgcucccagcaggccgugaucccgaacaucggcagccggccccgcauccggaacauccccucccgcaucucgaucuacuggacgaucguccggcccggcgacauccugcucaucaacuccaccgggaaccugaucgccccgcgcggcuacuucaagauccggagcgggaaguccucgaucaugcgcuccgacgcccccaucggcaagugcaacagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacccaggcggccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacaaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 11632 - RNA, 1701 nt, Artificial Sequence; identical to SEQ ID NO: 162
  derived and/or modified CDS sequence (AUadapt) from InfluenzaA__AHL95482__HA

SEQ ID NO: 11633 - RNA, 1701 nt, Artificial Sequence; identical to SEQ ID NO: 162
  derived and/or modified CDS sequence (AUadapt) from InfluenzaA__AHL95494__HA

SEQ ID NO: 11634 - RNA, 1701 nt, Artificial Sequence
  derived and/or modified CDS sequence (AUadapt) from InfluenzaA__AHL95506__HA
augaagaccaucaucgcccugucguacauccucugccugguguucgcccagaagcugcccggcaacgacaacuccaccgcgacgcucugccuggggcaccacgccgucccgaacggcaccaucgugcgcaccaucaccaacgaccggaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 11635 - RNA, 1701 nt, Artificial Sequence
  derived and/or modified CDS sequence (AUadapt) from InfluenzaA__AHL95518__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacguccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11636 - RNA, 1701 nt, Artificial Sequence; identical to SEQ ID NO: 10113
  derived and/or modified CDS sequence (AUadapt) from InfluenzaA__AHL95530__HA

SEQ ID NO: 11637 - RNA, 1701 nt, Artificial Sequence; identical to SEQ ID NO: 10113
  derived and/or modified CDS sequence (AUadapt) from InfluenzaA__AHL95542__HA

SEQ ID NO: 11638 - RNA, 1701 nt, Artificial Sequence
  derived and/or modified CDS sequence (AUadapt) from InfluenzaA__AHL95554__HA
augaagaccaucaucgcccugucguacauccucugccugguguucgcccagaagcugcccggcaacgacaacuccauggcgacccucugccuggggcaccacgccgucccgaacggcacgaucgugaagaccaucaccaacgaccgcaucgaggugaccaacgccacggagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggaccggggugacgcagaacggcaccagcuccgccugcauccggcgcucgaacuccagcuucuucucccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagucguccgggcgcaucaccgugagcaccaagcggagccagcaggccgugaucccgaacaucggcucccgcccccggauccgcaacauccccucgcggaucuccaucuacuggaccaucgucaagcccggcgacauccugcucaucaacagcacggggaaccugaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacccugaagcucgcgacgggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgcgugcaucggguccauccggaacggcacguacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11639 - RNA, 1701 nt, Artificial Sequence
  derived and/or modified CDS sequence (AUadapt) from InfluenzaA__AHL95566__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccggagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 11640 - RNA, 1701 nt, Artificial Sequence
  derived and/or modified CDS sequence (AUadapt) from InfluenzaA__AHL95578__HA
augaagaccaucaucgcccugucguacauccucugccugguguucgcccagaagcugcccggcaacgacgacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11641 - RNA, 1701 nt, Artificial Sequence
  derived and/or modified CDS sequence (AUadapt) from InfluenzaA__AHL95590__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccagcugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcccaguccagcgggcgcaucaccgugucgaccaagcggucccagcaggcggugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcagagcacgcugaagcucgccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagucgacccaggccgcgaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacaacguguaccgcgacgaggcgcucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 11642 - RNA, 1701 nt, Artificial Sequence; identical to SEQ ID NO: 10113
  derived and/or modified CDS sequence (AUadapt) from InfluenzaA__AHL95602__HA

SEQ ID NO: 11643 - RNA, 1701 nt, Artificial Sequence; identical to SEQ ID NO: 10113
  derived and/or modified CDS sequence (AUadapt) from InfluenzaA__AHL95614__HA

SEQ ID NO: 11644 - RNA, 1701 nt, Artificial Sequence
  derived and/or modified CDS sequence (AUadapt) from InfluenzaA__AHL95626__HA
augaagaccaucaucgcccugucguacgugcucugccuggucuucgcccagaagcugcccggcaacgacaacuccaccgcgacgcucugccuggggcaccacgccgugccgaacggcaccaucgugaagaccaucaccaacgaccgcaucgaggucacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccggccggaucaccgugagcaccaagcgcucgcagcaggccgucaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11645 - RNA, 1701 nt, Artificial Sequence; identical to SEQ ID NO: 10113
  derived and/or modified CDS sequence (AUadapt) from InfluenzaA__AHL95638__HA

SEQ ID NO: 11646 - RNA, 1701 nt, Artificial Sequence; identical to SEQ ID NO: 10113
  derived and/or modified CDS sequence (AUadapt) from InfluenzaA__AHL95650__HA

SEQ ID NO: 11647 - RNA, 1701 nt, Artificial Sequence
  derived and/or modified CDS sequence (AUadapt) from InfluenzaA__AHL95662__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucacccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 11648 - RNA, 1701 nt, Artificial Sequence; identical to SEQ ID NO: 162
  derived and/or modified CDS sequence (AUadapt) from InfluenzaA__AHL95686__HA

SEQ ID NO: 11649 - RNA, 1701 nt, Artificial Sequence; identical to SEQ ID NO: 162
  derived and/or modified CDS sequence (AUadapt) from InfluenzaA__AHL95698__HA

SEQ ID NO: 11650 - RNA, 1701 nt, Artificial Sequence; identical to SEQ ID NO: 10113
  derived and/or modified CDS sequence (AUadapt) from InfluenzaA__AHL95710__HA

SEQ ID NO: 11651 - RNA, 1701 nt, Artificial Sequence; identical to SEQ ID NO: 11627
  derived and/or modified CDS sequence (AUadapt) from InfluenzaA__AHL95722__HA

SEQ ID NO: 11652 - RNA, 1701 nt, Artificial Sequence; identical to SEQ ID NO: 10103
  derived and/or modified CDS sequence (AUadapt) from InfluenzaA__AHL95734__HA

SEQ ID NO: 11653 - RNA, 1701 nt, Artificial Sequence; identical to SEQ ID NO: 10103
  derived and/or modified CDS sequence (AUadapt) from InfluenzaA__AHL95746__HA

SEQ ID NO: 11654 - RNA, 1701 nt, Artificial Sequence; identical to SEQ ID NO: 10242
  derived and/or modified CDS sequence (AUadapt) from InfluenzaA__AHL95758__HA

SEQ ID NO: 11655 - RNA, 1701 nt, Artificial Sequence; identical to SEQ ID NO: 10113
  derived and/or modified CDS sequence (AUadapt) from InfluenzaA__AHL95770__HA

SEQ ID NO: 11656 - RNA, 1701 nt, Artificial Sequence
  derived and/or modified CDS sequence (AUadapt) from InfluenzaA__AHL95782__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11657 - RNA, 1701 nt, Artificial Sequence
  derived and/or modified CDS sequence (AUadapt) from InfluenzaA__AHL95794__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcggaacaaggccuacuccaacugcuaccccuacgacgugccggacuacgcgagccugcgcucccucgucgccucguccggcacccuggaguucaacaacgagagcuucaacugggccggggugacgcagaacggcaccuccucggccugcauccggggguccaacagcuccuucuucucgcgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcucgcagcaggccgugaucccgaacaucggcagccggccccgcauccggaacauccccucccgcaucucgaucuacuggaccaucgucaagcccggggacauccugcucaucaacuccacgggcaaccugaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 11658 - RNA, 1701 nt, Artificial Sequence
  derived and/or modified CDS sequence (AUadapt) from InfluenzaA__AHL95806__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucucgugcuuccugcugugcguggcccugcucgggagcaucaugugggcgugccagaagggcaacauccggugcaacaucugcaucuga

SEQ ID NO: 11659 - RNA, 1701 nt, Artificial Sequence; identical to SEQ ID NO: 162
  derived and/or modified CDS sequence (AUadapt) from InfluenzaA__AHL95818__HA

SEQ ID NO: 11660 - RNA, 1701 nt, Artificial Sequence; identical to SEQ ID NO: 10103
  derived and/or modified CDS sequence (AUadapt) from InfluenzaA__AHL95830__HA

SEQ ID NO: 11661 - RNA, 1701 nt, Artificial Sequence; identical to SEQ ID NO: 162
  derived and/or modified CDS sequence (AUadapt) from InfluenzaA__AHL95842__HA

SEQ ID NO: 11662 - RNA, 1701 nt, Artificial Sequence; identical to SEQ ID NO: 10103
  derived and/or modified CDS sequence (AUadapt) from InfluenzaA__AHL95854__HA

SEQ ID NO: 11663 - RNA, 1701 nt, Artificial Sequence; identical to SEQ ID NO: 10113
  derived and/or modified CDS sequence (AUadapt) from InfluenzaA__AHL95866__HA

SEQ ID NO: 11664 - RNA, 1701 nt, Artificial Sequence
  derived and/or modified CDS sequence (AUadapt) from InfluenzaA__AHL95878__HA
augaaggccauccuggugaucaugcucuacaccuucgccaccgcgaacgccgacacgcugugcaucggcuaccacgccaacaacucgaccgacaccgucgacaccgugcuggagaagaacgugacggucacccacuccgugaaccuccuggaggacaagcacaacgggaagcugugcaagcuccgcggcgugucgccccugcaccuggggaagugcaacaucgccggcuggauccucgggaacccggagugcgagucccugagcaccgccuccucgugguccuacaucgucgagaccucgggcuccgacaacggcacgugcuaccccggggacuucaucgacuacgaggagcugcgggagcagcucagcuccgugucguccuucgagcgcuucgagaucuuccccaagaccagcuccuggcccaaccacgacucgaacaagggcgugaccgcggccugcccgcacgccggggccaagggcuucuacaagaaccugaucuggcuggucaagaaggggaacuccuaccccaagcucucgaucuccuacaucaacgacaagggcaaggaggugcuggugcuguggggcauccaccaccccagcaccacggcggaccagcagucgcucuaccagaacgccgacaccuacgucuucguggggaccucccgguacagcaagaaguucaagcccgagaucgccauccgcccgaaggugcgggaccaggagggccgcaugaacuacuacuggacccuggucgagcccggggacaagaucacguucgaggccaccggcaaccugguggugccccgguacgccuucgcgauggagcgcaacgccggcuccgggaucaucaucucggacacccccguccacgacugcaacaccacgugccagaccccgaagggcgccaucaacaccucccuccccuuccagaacauccaccccaucaccaucgggaagugccccaaguacgucaagucgacgaagcugcggcuggccaccggccuccgcaacgugccguccauccagagccgggggcuguucggcgccaucgcgggcuucaucgagggcggguggaccgggaugguggacggcugguacggguaccaccaccagaacgagcagggcuccggcuacgccgccgaccucaagucgacccagaacgccaucgacaagaucacgaacaaggugaacuccgugaucgagaagaugaacacccaguucaccgccgucgggaaggaguucaaccaccuggagaagcgcaucgagaaccugaacaagaagguggacgacggcuuccuggacaucuggaccuacaacgcggagcuccugguccugcucgagaacgagcggacgcuggacuaccacgacagcaacgugaagaaccuguacgagaaggugcgcaaccagcucaagaacaacgccaaggagaucgggaacggcugcuucgaguucuaccacaagugcgacaacacgugcauggaguccgucaagaacgggaccuacgacuaccccaaguacucggaggaggccaagcugaaccgggaggagaucgacggcgugaagcuggaguccacccgcaucuaccagauccucgccaucuacucgaccgccgcguccagccuggugcuggucgugucccucggcgccaucucguucuggaugugcagcaacgggucccugcagugccggaucugcaucuga

SEQ ID NO: 11665 - RNA, 1701 nt, Artificial Sequence; identical to SEQ ID NO: 10113
  derived and/or modified CDS sequence (AUadapt) from InfluenzaA__AHL95889__HA

SEQ ID NO: 11666 - RNA, 1701 nt, Artificial Sequence; identical to SEQ ID NO: 162
  derived and/or modified CDS sequence (AUadapt) from InfluenzaA__AHL95901__HA

SEQ ID NO: 11667 - RNA, 1701 nt, Artificial Sequence; identical to SEQ ID NO: 162
  derived and/or modified CDS sequence (AUadapt) from InfluenzaA__AHL95913__HA

SEQ ID NO: 11668 - RNA, 1701 nt, Artificial Sequence
  derived and/or modified CDS sequence (AUadapt) from InfluenzaA__AHL95937__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacacgaagaccgaccugugguccuacaacgccgagcuccugguggcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11669 - RNA, 1701 nt, Artificial Sequence
  derived and/or modified CDS sequence (AUadapt) from InfluenzaA__AHL95949__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacaugacgaugcccaacaacgagcaguucgacaagcuguacaucuggggcgugcaccaccccgggaccgacaaggaccagaucuuccucuacgcgcagagcuccgggcgcaucaccgucucgaccaagcggagccagcaggccgugaucccgaacaucggcucccgcccccggauccgcaacauccccucgcggaucuccaucuacuggacgaucgugaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgucaaccggaucaccuacggggccugcccccgcuacgugaagcaguccacgcugaagcuggcgaccggcaugcggaacgugcccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggaggucgagggccgcauccaggaccucgagaaguacguggaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 11670 - RNA, 1701 nt, Artificial Sequence; identical to SEQ ID NO: 10113
  derived and/or modified CDS sequence (AUadapt) from InfluenzaA__AHL95961__HA

SEQ ID NO: 11671 - RNA, 1701 nt, Artificial Sequence; identical to SEQ ID NO: 10113
  derived and/or modified CDS sequence (AUadapt) from InfluenzaA__AHL95973__HA

SEQ ID NO: 11672 - RNA, 1701 nt, Artificial Sequence; identical to SEQ ID NO: 10113
  derived and/or modified CDS sequence (AUadapt) from InfluenzaA__AHL95985__HA

SEQ ID NO: 11673 - RNA, 1701 nt, Artificial Sequence
  derived and/or modified CDS sequence (AUadapt) from InfluenzaA__AHL95997__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaagagcuccuucuucucgcgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcaguccagcggccggaucaccgugucgaccaagcgcucccagcaggccgugaucccgaacaucggcagccggccccgcauccggaacauccccucccgcaucucgaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaagucggagugcaucacccccaacggguccauccccaacgacaagccguuccagaacgugaaccgcaucaccuacggcgccugcccccgguacgugaagcagagcacccugaagcucgcgacggggaugcgcaacguccccgagaagcagacccggggcaucuucggggccaucgccggcuucaucgagaacggcugggaggggaugauggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 11674 - RNA, 1701 nt, Artificial Sequence
  derived and/or modified CDS sequence (AUadapt) from InfluenzaA__AHL96021__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaaguccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11675 - RNA, 1701 nt, Artificial Sequence; identical to SEQ ID NO: 10113
  derived and/or modified CDS sequence (AUadapt) from InfluenzaA__AHL96033__HA

SEQ ID NO: 11676 - RNA, 1701 nt, Artificial Sequence; identical to SEQ ID NO: 10368
  derived and/or modified CDS sequence (AUadapt) from InfluenzaA__AHL96045__HA

SEQ ID NO: 11677 - RNA, 1701 nt, Artificial Sequence; identical to SEQ ID NO: 162
  derived and/or modified CDS sequence (AUadapt) from InfluenzaA__AHL96056__HA

SEQ ID NO: 11678 - RNA, 1701 nt, Artificial Sequence; identical to SEQ ID NO: 10103
  derived and/or modified CDS sequence (AUadapt) from InfluenzaA__AHL96068__HA

SEQ ID NO: 11679 - RNA, 1701 nt, Artificial Sequence; identical to SEQ ID NO: 10113
  derived and/or modified CDS sequence (AUadapt) from InfluenzaA__AHL96080__HA

SEQ ID NO: 11680 - RNA, 1701 nt, Artificial Sequence
  derived and/or modified CDS sequence (AUadapt) from InfluenzaA__AHL96092__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcucgcucguggccuccagcggcacccuggaguucaacaacgaguccuucaacugggccggggucacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcgugcaccaccccgggacggacaaggaccagaucuuccuguacgcccagagcuccggccggaucaccgucagcaccaagcgcucgcagcaggccgugaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggauggucgacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11681 - RNA, 1701 nt, Artificial Sequence
  derived and/or modified CDS sequence (AUadapt) from InfluenzaA__AHL96104__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagcgccagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11682 - RNA, 1701 nt, Artificial Sequence; identical to SEQ ID NO: 10727
  derived and/or modified CDS sequence (AUadapt) from InfluenzaA__AHL96116__HA

SEQ ID NO: 11683 - RNA, 1701 nt, Artificial Sequence; identical to SEQ ID NO: 10103
  derived and/or modified CDS sequence (AUadapt) from InfluenzaA__AHL96128__HA

SEQ ID NO: 11684 - RNA, 1701 nt, Artificial Sequence; identical to SEQ ID NO: 162
  derived and/or modified CDS sequence (AUadapt) from InfluenzaA__AHL96152__HA

SEQ ID NO: 11685 - RNA, 1701 nt, Artificial Sequence
  derived and/or modified CDS sequence (AUadapt) from InfluenzaA__AHL96164__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaagaacuggauccuguggaucuccuucgccaucagcugcuuccugcugugcguggcccugcucggguucaucaugugggcgugccagaagggcaacauccggugcaacaucugcaucuga

SEQ ID NO: 11686 - RNA, 1701 nt, Artificial Sequence; identical to SEQ ID NO: 162
  derived and/or modified CDS sequence (AUadapt) from InfluenzaA__AHL96176__HA

SEQ ID NO: 11687 - RNA, 1701 nt, Artificial Sequence; identical to SEQ ID NO: 162
  derived and/or modified CDS sequence (AUadapt) from InfluenzaA__AHL96188__HA

SEQ ID NO: 11688 - RNA, 1701 nt, Artificial Sequence
  derived and/or modified CDS sequence (AUadapt) from InfluenzaA__AHL96200__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccaggugcucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccggccggaucaccgugagcaccaagcgcucgcagcaggccgucaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11689 - RNA, 1701 nt, Artificial Sequence; identical to SEQ ID NO: 10103
  derived and/or modified CDS sequence (AUadapt) from InfluenzaA__AHL96212__HA

SEQ ID NO: 11690 - RNA, 1701 nt, Artificial Sequence; identical to SEQ ID NO: 10712
  derived and/or modified CDS sequence (AUadapt) from InfluenzaA__AHL96224__HA

SEQ ID NO: 11691 - RNA, 1701 nt, Artificial Sequence
  derived and/or modified CDS sequence (AUadapt) from InfluenzaA__AHL96236__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaugggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucgaguccauccggaacgggaccuacgaccacgacguguaccgcgacgaggcccucaacaaccgguuccagaucaagggcgucgagcucaagagcggguacaagaacuggauccuguggaucuccuucgccaucagcugcuuccugcugugcguggcccugcucggcuucaucaugugggccugccagaagggcaacauccgcugcaacaucugcaucuga

SEQ ID NO: 11692 - RNA, 1701 nt, Artificial Sequence
  derived and/or modified CDS sequence (AUadapt) from InfluenzaA__AHL96248__HA
augaagaccaucaucgcccugggcuacauccucugccugguguucgcccagaagcugcccgggaacgacaacucgaccgcgacgcucugccugggccaccacgccgucccgaacgggaccaucgugaagaccaucaccaacgaccgcaucgaggugacgaacgccaccgagcugguccagaacuccagcaucggcgagaucugcgacucgccccaccagauccucgacggggagaacugcacccugaucgacgcccugcucggcgacccccagugcgacggcuuccagaacaagaagugggaccuguucaucgagcggagcaaggccuacuccaacugcuaccccuacgacgugccggacuacgcgucgcugcgcucccucguggccagcuccgggacccuggaguucaacaacgagucguucaacuggacgggcgucacccagaacgggaccuccagcgccugcauccggcgcuccaacucguccuucuucagccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgcaguccucgggccgcaucaccgucuccaccaagcggagccagcaggccgugaucccgaacaucggcucgcgcccccggauccgcaacauccccucccggaucagcaucuacuggacgaucgugaagcccggggacauccugcucaucaacuccaccggcaaccugaucgccccgcgcggguacuucaagauccggucgggcaaguccagcaucaugcgcuccgacgcccccaucggcaagugcaagucggagugcaucacccccaacggguccauccccaacgacaagccguuccagaacgucaaccggaucaccuacggcgccugcccccgcuacgugaagcagagcacgcugaagcucgcgaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgccgaccugaaguccacccaggcggccaucgaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggucguacaacgccgagcuccuggucgcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 11693 - RNA, 1701 nt, Artificial Sequence; identical to SEQ ID NO: 162
  derived and/or modified CDS sequence (AUadapt) from InfluenzaA__AHL96260__HA

SEQ ID NO: 11694 - RNA, 1701 nt, Artificial Sequence; identical to SEQ ID NO: 10103
  derived and/or modified CDS sequence (AUadapt) from InfluenzaA__AHL96274__HA

SEQ ID NO: 11695 - RNA, 1701 nt, Artificial Sequence; identical to SEQ ID NO: 162
  derived and/or modified CDS sequence (AUadapt) from InfluenzaA__AHL96304__HA

SEQ ID NO: 11696 - RNA, 1701 nt, Artificial Sequence; identical to SEQ ID NO: 10080
  derived and/or modified CDS sequence (AUadapt) from InfluenzaA__AHL96318__HA

SEQ ID NO: 11697 - RNA, 1701 nt, Artificial Sequence; identical to SEQ ID NO: 162
  derived and/or modified CDS sequence (AUadapt) from InfluenzaA__AHL96330__HA

SEQ ID NO: 11698 - RNA, 1701 nt, Artificial Sequence; identical to SEQ ID NO: 10242
  derived and/or modified CDS sequence (AUadapt) from InfluenzaA__AHL96342__HA

SEQ ID NO: 11699 - RNA, 1701 nt, Artificial Sequence
  derived and/or modified CDS sequence (AUadapt) from InfluenzaA__AHL96354__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccugaacucggagggccgggggcaggccgcggaccugaaguccacccaggccgccaucgaccagaucaacggcaagcucaaccgccugaucggcaagaccaacgagaaguuccaccagaucgagaaggaguucagcgagguggaggggcggauccaggaccuggagaaguacgucgaggacacgaagaucgaccucugguccuacaacgccgagcugcugguggcccucgagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcugugcguggcccuccugggguucaucaugugggcgugccagaagggcaacauccggugcaacaucugcaucuga

SEQ ID NO: 11700 - RNA, 1701 nt, Artificial Sequence
  derived and/or modified CDS sequence (AUadapt) from InfluenzaA__AHL96366__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccgcaucgaggugacgaacgccaccgagcugguccagaacagcuccaucggcgagaucugcgacucgccccaccagauccucgacggggagaacugcacccugaucgacgcccugcucggcgacccccagugcgacggguuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggcgugacgcagaacgggaccucguccgccugcauccggggcagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcggaucaccgugagcaccaagcgcucgcagcaggccgugaucccgaacaucggcucccggccccgcauccggaacauccccagccgcaucuccaucuacuggaccaucgucaagcccggcgacauccugcucaucaacucgacggggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggcgugcccccgguacgugaagcaguccacccugaagcucgccacgggcaugcgcaacguccccgagaagcagacccgggggaucuucggcgccaucgccggguucaucgagaacggcugggagggcaugguggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 11701 - RNA, 1701 nt, Artificial Sequence; identical to SEQ ID NO: 10113
  derived and/or modified CDS sequence (AUadapt) from InfluenzaA__AHL96378__HA

SEQ ID NO: 11702 - RNA, 1701 nt, Artificial Sequence; identical to SEQ ID NO: 10103
  derived and/or modified CDS sequence (AUadapt) from InfluenzaA__AHL96390__HA

SEQ ID NO: 11703 - RNA, 1701 nt, Artificial Sequence
  derived and/or modified CDS sequence (AUadapt) from InfluenzaA__AHL96402__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcaacuccucguucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugagcaccaagcgcucgcagcaggccgugaucccgaacaucggcucccggccccgcauccggaacauccccagccgcaucuccaucuacuggacgaucgucaagcccggggacauccugcugaucaacucgaccggcaaccucaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccucaaguccacccaggcggccaucgaccagaucaacggcaagcugaaccgccugaucggcaagacgaacaagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 11704 - RNA, 1701 nt, Artificial Sequence; identical to SEQ ID NO: 10113
  derived and/or modified CDS sequence (AUadapt) from InfluenzaA__AHL96414__HA

SEQ ID NO: 11705 - RNA, 1701 nt, Artificial Sequence; identical to SEQ ID NO: 162
  derived and/or modified CDS sequence (AUadapt) from InfluenzaA__AHL96426__HA

SEQ ID NO: 11706 - RNA, 1701 nt, Artificial Sequence
  derived and/or modified CDS sequence (AUadapt) from InfluenzaA__AHL96438__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcagcuccgcgugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11707 - RNA, 1701 nt, Artificial Sequence; identical to SEQ ID NO: 10113
  derived and/or modified CDS sequence (AUadapt) from InfluenzaA__AHL96450__HA

SEQ ID NO: 11708 - RNA, 1701 nt, Artificial Sequence; identical to SEQ ID NO: 162
  derived and/or modified CDS sequence (AUadapt) from InfluenzaA__AHL96462__HA

SEQ ID NO: 11709 - RNA, 1701 nt, Artificial Sequence
  derived and/or modified CDS sequence (AUadapt) from InfluenzaA__AHL96474__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucucgccccugcaccuggggaagugcaacaucgccggcuggauccucgggaacccggagugcgagucccugagcaccgccuccucgugguccuacaucguggagaccucgggcuccgacaacggcacgugcuaccccggggacuucaucgacuacgaggagcugcgggagcagcucagcuccgugucguccuucgagcgcuucgagaucuuccccaagaccagcuccuggcccaaccacgacucgaacaagggcgucaccgcggccugcccgcacgccggggccaagggcuucuacaagaaccugaucuggcuggugaagaaggggaacuccuaccccaagcucucgaucuccuacaucaacgacaagggcaaggaggugcugguccuguggggcauccaccaccccagcaccacggcggaccagcagucgcucuaccagaacgccgacaccuacguguucguggggaccucccgguacagcaagaaguucaagcccgagaucgccauccgcccgaagguccgggaccaggagggccgcaugaacuacuacuggacccugguggagcccggggacaagaucacguucgaggccaccggcaaccugguggucccccgguacgccuucgcgauggagcgcaacgccggcuccgggaucaucaucucggacacccccgugcacgacugcaacaccacgugccagaccccgaagggcgccaucaacaccucccuccccuuccagaacauccaccccaucaccaucgggaagugccccaaguacgucaagucgacgaagcugcggcuggccaccggccuccgcaacgugccguccauccagagccgggggcuguucggcgccaucgcgggcuucaucgagggcggguggaccgggaugguggacggcugguacggguaccaccaccagaacgagcagggcuccggcuacgccgccgaccucaagucgacccagaacgccaucgacaagaucacgaacaaggugaacuccgucaucgagaagaugaacacccaguucaccgccguggggaaggaguucaaccaccuggagaagcgcaucgagaaccugaacaagaaggucgacgacggcuuccuggacaucuggaccuacaacgcggagcuccuggugcugcucgagaacgagcggacgcuggacuaccacgacagcaacgugaagaaccuguacgagaagguccgcaaccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgccaucuacucgaccgccgcguccagccugguccugguggugucccucggcgccaucucguucuggaugugcagcaacgggucccugcagugccggaucugcaucuga

SEQ ID NO: 11710 - RNA, 1701 nt, Artificial Sequence
  derived and/or modified CDS sequence (AUadapt) from InfluenzaA__AHL96485__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugaaguccgacgcccccaucgggaagugcaagucggagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11711 - RNA, 1701 nt, Artificial Sequence; identical to SEQ ID NO: 162
  derived and/or modified CDS sequence (AUadapt) from InfluenzaA__AHL96497__HA

SEQ ID NO: 11712 - RNA, 1701 nt, Artificial Sequence; identical to SEQ ID NO: 10113
  derived and/or modified CDS sequence (AUadapt) from InfluenzaA__AHL96509__HA

SEQ ID NO: 11713 - RNA, 1701 nt, Artificial Sequence; identical to SEQ ID NO: 10080
  derived and/or modified CDS sequence (AUadapt) from InfluenzaA__AHL96521__HA

SEQ ID NO: 11714 - RNA, 1701 nt, Artificial Sequence; identical to SEQ ID NO: 162
  derived and/or modified CDS sequence (AUadapt) from InfluenzaA__AHL96533__HA

SEQ ID NO: 11715 - RNA, 1701 nt, Artificial Sequence; identical to SEQ ID NO: 10103
  derived and/or modified CDS sequence (AUadapt) from InfluenzaA__AHL96545__HA

SEQ ID NO: 11716 - RNA, 1701 nt, Artificial Sequence
  derived and/or modified CDS sequence (AUadapt) from InfluenzaA__AHL96569__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcgugaccgugagcaccaagcggucgcagcaggccgucaucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11717 - RNA, 1701 nt, Artificial Sequence; identical to SEQ ID NO: 11709
  derived and/or modified CDS sequence (AUadapt) from InfluenzaA__AHL96581__HA

SEQ ID NO: 11718 - RNA, 1701 nt, Artificial Sequence
  derived and/or modified CDS sequence (AUadapt) from InfluenzaA__AHL96592__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccaccagauccuggacggggagaacugcacccucaucgacgcccugcugggcgacccccagugcgacggcuuccagaacaagaagugggaccucuucaucgagcgguccaaggccuacuccaacugcuaccccuacgacgugccggacuacgcgagccugcgcucccugguggccucguccgggacccucgaguucaacaacgagagcuucaacuggacgggcgucacccagaacgggaccuccucggccugcauccggcgcuccaacagcuccuucuucucgcggcugaacuggcugacccaccucaacuucaaguaccccgcccugaacgugacgaugcccaacaacgagcaguucgacaagcuguacaucuggggcgugcaccaccccgggaccgacaaggaccagaucuuccucuacgcgcaguccagcggccgcaucaccgucuccaccaagcggucgcagcaggccgugaucccgaacaucggcagccgcccccggauccgcaacauccccucccggaucucgaucuacuggacgaucgugaagcccggggacauccugcugaucaacuccaccggcaaccucaucgccccgcgcggguacuucaagauccggagcggcaaguccucgaucaugcgcuccgacgcccccaucggcaagugcaagagcgagugcaucacccccaacggguccauccccaacgacaagccguuccagaacgucaaccggaucaccuacggcgccugcccccgcuacgugaagcagucgacgcugaagcuggcgaccgggaugcggaacgugcccgagaagcagacccgcggcaucuucggggccaucgccggcuucaucgagaacggcugggaggggauggucgacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccucgagaaguacguggaggacaccaagaucgaccuguggucguacaacgccgagcugcucgucgcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcguggagcucaaguccggcuacaaggacuggauccuguggaucagcuucgccaucuccugcuuccugcucugcgucgcccugcugggguucaucaugugggccugccagaagggcaacauccgcugcaacaucugcaucuga

SEQ ID NO: 11719 - RNA, 1701 nt, Artificial Sequence; identical to SEQ ID NO: 162
  derived and/or modified CDS sequence (AUadapt) from InfluenzaA__AHL96604__HA

SEQ ID NO: 11720 - RNA, 1701 nt, Artificial Sequence; identical to SEQ ID NO: 162
  derived and/or modified CDS sequence (AUadapt) from InfluenzaA__AHL96616__HA

SEQ ID NO: 11721 - RNA, 1701 nt, Artificial Sequence
  derived and/or modified CDS sequence (AUadapt) from InfluenzaA__AHL96628__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcuggggcgggaugguggacggcugguacggguuccggcaccagaacucggagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacaacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 11722 - RNA, 1701 nt, Artificial Sequence; identical to SEQ ID NO: 11710
  derived and/or modified CDS sequence (AUadapt) from InfluenzaA__AHL96640__HA

SEQ ID NO: 11723 - RNA, 1701 nt, Artificial Sequence
  derived and/or modified CDS sequence (AUadapt) from InfluenzaA__AHL96652__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccaggacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11724 - RNA, 1701 nt, Artificial Sequence; identical to SEQ ID NO: 10712
  derived and/or modified CDS sequence (AUadapt) from InfluenzaA__AHL96664__HA

SEQ ID NO: 11725 - RNA, 1701 nt, Artificial Sequence
  derived and/or modified CDS sequence (AUadapt) from InfluenzaA__AHL96676__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcagcauccccaucgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11726 - RNA, 1701 nt, Artificial Sequence; identical to SEQ ID NO: 162
  derived and/or modified CDS sequence (AUadapt) from InfluenzaA__AHL96688__HA

SEQ ID NO: 11727 - RNA, 1701 nt, Artificial Sequence; identical to SEQ ID NO: 162
  derived and/or modified CDS sequence (AUadapt) from InfluenzaA__AHL96700__HA

SEQ ID NO: 11728 - RNA, 1701 nt, Artificial Sequence; identical to SEQ ID NO: 162
  derived and/or modified CDS sequence (AUadapt) from InfluenzaA__AHL96712__HA

SEQ ID NO: 11729 - RNA, 1701 nt, Artificial Sequence; identical to SEQ ID NO: 10113
  derived and/or modified CDS sequence (AUadapt) from InfluenzaA__AHL96724__HA

SEQ ID NO: 11730 - RNA, 1701 nt, Artificial Sequence; identical to SEQ ID NO: 10103
  derived and/or modified CDS sequence (AUadapt) from InfluenzaA__AHL96748__HA

SEQ ID NO: 11731 - RNA, 1701 nt, Artificial Sequence; identical to SEQ ID NO: 10113
  derived and/or modified CDS sequence (AUadapt) from InfluenzaA__AHL96784__HA

SEQ ID NO: 11732 - RNA, 1701 nt, Artificial Sequence
  derived and/or modified CDS sequence (AUadapt) from InfluenzaA__AHL96796__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucaucgagcgguccaaggccuacagcaacugcuaccccuacgacgugccggacuacgcgucccugcgcucgcucguggccuccagcggcacccuggaguucaacaacgaguccuucaacuggacgggggucacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgcagagcuccgggcgcaucaccgucagcaccaagcggucgcagcaggccgugaucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgucaaccggaucaccuacggggccugcccccgcuacgugaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 11733 - RNA, 1701 nt, Artificial Sequence; identical to SEQ ID NO: 10103
  derived and/or modified CDS sequence (AUadapt) from InfluenzaA__AHL96808__HA

SEQ ID NO: 11734 - RNA, 1701 nt, Artificial Sequence; identical to SEQ ID NO: 10103
  derived and/or modified CDS sequence (AUadapt) from InfluenzaA__AHL96820__HA

SEQ ID NO: 11735 - RNA, 1701 nt, Artificial Sequence; identical to SEQ ID NO: 10113
  derived and/or modified CDS sequence (AUadapt) from InfluenzaA__AHL96832__HA

SEQ ID NO: 11736 - RNA, 1701 nt, Artificial Sequence; identical to SEQ ID NO: 10113
  derived and/or modified CDS sequence (AUadapt) from InfluenzaA__AHL96844__HA

SEQ ID NO: 11737 - RNA, 1701 nt, Artificial Sequence; identical to SEQ ID NO: 10113
  derived and/or modified CDS sequence (AUadapt) from InfluenzaA__AHL96856__HA

SEQ ID NO: 11738 - RNA, 1701 nt, Artificial Sequence
  derived and/or modified CDS sequence (AUadapt) from InfluenzaA__AHL96868__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgggaacugcacccugaucgacgcccugcucggcgacccccagugcgacggcuuccagaacaagaagugggaccuguucguggagcgguccaaggccuacagcaacugcuaccccuacgacgugccggacuacgcgucccugcgcucgcucgucgccuccagcgggacccuggaguucaacaacgaguccuucaacuggacgggcgugacccagaacgggaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggucgcagcaggccguggucccgaacaucggcucccgcccccggauccgcaacauccccagccggaucuccaucuacuggacgaucgugaagcccggggacauccugcucaucaacucgaccggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgccugcccccgcuacgucaagcaguccacgcugaagcucgcgaccgggaugcggaacgugcccgagaagcagacccgcggcaucuucggggccaucgccggcuucaucgagaacggcugggaggggaugauggacggcugguacggguuccggcaccagaacucggagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggcuacaaggacuggauccuguggaucuccuucgccaugagcugcuuccugcugugcguggcccugcucggguucaucaugugggccugccagaagggcaacauccgcugcaacaucugcaucuga

SEQ ID NO: 11739 - RNA, 1701 nt, Artificial Sequence; identical to SEQ ID NO: 10103
  derived and/or modified CDS sequence (AUadapt) from InfluenzaA__AHL96880__HA

SEQ ID NO: 11740 - RNA, 1701 nt, Artificial Sequence
  derived and/or modified CDS sequence (AUadapt) from InfluenzaA__AHL96892__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggguccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11741 - RNA, 1701 nt, Artificial Sequence
  derived and/or modified CDS sequence (AUadapt) from InfluenzaA__AHL96904__HA
augaagaccaucaucgcccugucguacauccucugccugguguucgcccagaagcugcccggcaacgacaacuccaccgcgacgcucugccuggggcaccacgccgucccgaacggcaugaucgugaagaccaucaccaacgaccgcaucgaggugaccaacgccacggagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggaccggggugacgcagaacggcaccucguccgccugcauccggcgcagcaacuccucguucuucucccggcugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccgggcgcaucaccgugucgaccaagcggagccagcaggccguggucccgaacaucggcucccgcccccggauccgcaacauccccucgcggaucuccaucuacuggaccaucgugaagcccggcgacauccugcucaucaacagcacggggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgucaagcaguccacccugaagcucgcgacgggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucucggaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcacguacgaccacgacgucuaccgcgacgaggcccucaacaaccgguuccagaucaaggggguggagcucaagucgggcuacaaggacuggauccuguggaucuccuucgccaugagcugcuuccugcugugcguggcccugcucggcagcaucaugugggccugccagaaggggaacauccgcugcaacaucugcaucuga

SEQ ID NO: 11742 - RNA, 1701 nt, Artificial Sequence; identical to SEQ ID NO: 10103
  derived and/or modified CDS sequence (AUadapt) from InfluenzaA__AHL96916__HA

SEQ ID NO: 11743 - RNA, 1701 nt, Artificial Sequence; identical to SEQ ID NO: 10103
  derived and/or modified CDS sequence (AUadapt) from InfluenzaA__AHL96928__HA

SEQ ID NO: 11744 - RNA, 1701 nt, Artificial Sequence; identical to SEQ ID NO: 10103
  derived and/or modified CDS sequence (AUadapt) from InfluenzaA__AHL96940__HA

SEQ ID NO: 11745 - RNA, 1701 nt, Artificial Sequence; identical to SEQ ID NO: 10113
  derived and/or modified CDS sequence (AUadapt) from InfluenzaA__AHL96952__HA

SEQ ID NO: 11746 - RNA, 1701 nt, Artificial Sequence; identical to SEQ ID NO: 10113
  derived and/or modified CDS sequence (AUadapt) from InfluenzaA__AHL96964__HA

SEQ ID NO: 11747 - RNA, 1701 nt, Artificial Sequence; identical to SEQ ID NO: 10271
  derived and/or modified CDS sequence (AUadapt) from InfluenzaA__AHL96976__HA

SEQ ID NO: 11748 - RNA, 1701 nt, Artificial Sequence
  derived and/or modified CDS sequence (AUadapt) from InfluenzaA__AHL96988__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucguccgccccggcgacauccugcucaucaacucgaccgggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11749 - RNA, 1701 nt, Artificial Sequence; identical to SEQ ID NO: 10113
  derived and/or modified CDS sequence (AUadapt) from InfluenzaA__AHL97000__HA

SEQ ID NO: 11750 - RNA, 1701 nt, Artificial Sequence; identical to SEQ ID NO: 162
  derived and/or modified CDS sequence (AUadapt) from InfluenzaA__AHL97012__HA

SEQ ID NO: 11751 - RNA, 1701 nt, Artificial Sequence
  derived and/or modified CDS sequence (AUadapt) from InfluenzaA__AHL97024__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaugaacgaccgcaucgaggugaccaacgccacggagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacccagaacggcacgagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggaccgacaaggaccagaucuuccuguacgcccagucguccggccggaucacggugagcaccaagcgcagccagcaggccgugaucccgaacaucggcucccggccccgcauccggaacauccccucgcgcaucuccaucuacuggaccaucgucaagcccggggacauccugcucaucaacagcaccggcaaccugaucgccccgcggggguacuucaagauccgcuccggcaagucguccaucaugcggagcgacgcccccaucggcaagugcaaguccgagugcaucacgcccaacgggagcauccccaacgacaagccguuccagaacgugaaccgcaucaccuacggcgcgugcccccgguacgugaagcaguccacccugaagcucgccaccgggaugcgcaacguccccgagaagcagacgcggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11752 - RNA, 1701 nt, Artificial Sequence
  derived and/or modified CDS sequence (AUadapt) from InfluenzaA__AHL97036__HA
augaagaccaucaucgcccugucguacauccucugccugguguucgcccagaagcugcccggcaacgacaacuccaccgcgacccucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacacgugcaucggguccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11753 - RNA, 1701 nt, Artificial Sequence; identical to SEQ ID NO: 10128
  derived and/or modified CDS sequence (AUadapt) from InfluenzaA__AHL97048__HA

SEQ ID NO: 11754 - RNA, 1701 nt, Artificial Sequence
  derived and/or modified CDS sequence (AUadapt) from InfluenzaA__AHL97060__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcaacuccucguucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgagcacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 11755 - RNA, 1701 nt, Artificial Sequence; identical to SEQ ID NO: 162
  derived and/or modified CDS sequence (AUadapt) from InfluenzaA__AHL97072__HA

SEQ ID NO: 11756 - RNA, 1701 nt, Artificial Sequence; identical to SEQ ID NO: 162
  derived and/or modified CDS sequence (AUadapt) from InfluenzaA__AHL97084__HA

SEQ ID NO: 11757 - RNA, 1701 nt, Artificial Sequence; identical to SEQ ID NO: 10080
  derived and/or modified CDS sequence (AUadapt) from InfluenzaA__AHL97096__HA

SEQ ID NO: 11758 - RNA, 1701 nt, Artificial Sequence; identical to SEQ ID NO: 10242
  derived and/or modified CDS sequence (AUadapt) from InfluenzaA__AHL97108__HA

SEQ ID NO: 11759 - RNA, 1701 nt, Artificial Sequence
  derived and/or modified CDS sequence (AUadapt) from InfluenzaA__AHL97120__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcgugaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccaucaucaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 11760 - RNA, 1701 nt, Artificial Sequence
  derived and/or modified CDS sequence (AUadapt) from InfluenzaA__AHL97132__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccggcaagcagacccgcgggaucuucggcgccaucgccggcuucaucgagaacgggugggagggcaugguggacgggugguacggcuuccggcaccagaacucggaggggcgcggccaggccgcggaccugaaguccacccaggccgccaucgaccagaucaacggcaagcugaaccggcucaucgggaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgggagaacgcggaggacauggggaacggcugcuucaagaucuaccacaagugcgacaacgccugcaucggguccauccgcaacggcacguacgaccacgacguguaccgcgacgaggcccucaacaaccgguuccagaucaagggcgucgagcucaagagcggguacaaggacuggauccuguggaucuccuucgccaucagcugcuuccugcugugcguggcccugcucggcuucaucaugugggcgugccagaaggggaacauccgcugcaacaucugcaucuga

SEQ ID NO: 11761 - RNA, 1701 nt, Artificial Sequence; identical to SEQ ID NO: 162
  derived and/or modified CDS sequence (AUadapt) from InfluenzaA__AHL97144__HA

SEQ ID NO: 11762 - RNA, 1701 nt, Artificial Sequence; identical to SEQ ID NO: 162
  derived and/or modified CDS sequence (AUadapt) from InfluenzaA__AHL97156__HA

SEQ ID NO: 11763 - RNA, 1701 nt, Artificial Sequence; identical to SEQ ID NO: 162
  derived and/or modified CDS sequence (AUadapt) from InfluenzaA__AHL97168__HA

SEQ ID NO: 11764 - RNA, 1701 nt, Artificial Sequence; identical to SEQ ID NO: 10113
  derived and/or modified CDS sequence (AUadapt) from InfluenzaA__AHL97180__HA

SEQ ID NO: 11765 - RNA, 1701 nt, Artificial Sequence; identical to SEQ ID NO: 162
  derived and/or modified CDS sequence (AUadapt) from InfluenzaA__AHL97192__HA

SEQ ID NO: 11766 - RNA, 1701 nt, Artificial Sequence; identical to SEQ ID NO: 162
  derived and/or modified CDS sequence (AUadapt) from InfluenzaA__AHL97204__HA

SEQ ID NO: 11767 - RNA, 1701 nt, Artificial Sequence; identical to SEQ ID NO: 162
  derived and/or modified CDS sequence (AUadapt) from InfluenzaA__AHL97216__HA

SEQ ID NO: 11768 - RNA, 1701 nt, Artificial Sequence
  derived and/or modified CDS sequence (AUadapt) from InfluenzaA__AHL97228__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccucggggcgcaucaccguguccaccaagcggagccagcaggccgucaucccgaacaucggcucgcgcccccggauccgcaacauccccucccggaucagcaucuacuggacgaucgugaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgucaagcagucgacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 11769 - RNA, 1701 nt, Artificial Sequence; identical to SEQ ID NO: 162
  derived and/or modified CDS sequence (AUadapt) from InfluenzaA__AHL97240__HA

SEQ ID NO: 11770 - RNA, 1701 nt, Artificial Sequence
  derived and/or modified CDS sequence (AUadapt) from InfluenzaA__AHL97252__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagaacuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugucgacgaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgcgugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11771 - RNA, 1701 nt, Artificial Sequence; identical to SEQ ID NO: 10103
  derived and/or modified CDS sequence (AUadapt) from InfluenzaA__AHL97264__HA

SEQ ID NO: 11772 - RNA, 1701 nt, Artificial Sequence; identical to SEQ ID NO: 162
  derived and/or modified CDS sequence (AUadapt) from InfluenzaA__AHL97276__HA

SEQ ID NO: 11773 - RNA, 1701 nt, Artificial Sequence
  derived and/or modified CDS sequence (AUadapt) from InfluenzaA__AHL97288__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagaucaagaagcagcugcgcgagaacgccgaggacauggggaacggcugcuucaagaucuaccacaagugcgacaacgcgugcaucggguccauccggaacggcacguacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11774 - RNA, 1701 nt, Artificial Sequence; identical to SEQ ID NO: 10113
  derived and/or modified CDS sequence (AUadapt) from InfluenzaA__AHL97300__HA

SEQ ID NO: 11775 - RNA, 1701 nt, Artificial Sequence; identical to SEQ ID NO: 162
  derived and/or modified CDS sequence (AUadapt) from InfluenzaA__AHL97312__HA

SEQ ID NO: 11776 - RNA, 1701 nt, Artificial Sequence; identical to SEQ ID NO: 162
  derived and/or modified CDS sequence (AUadapt) from InfluenzaA__AHL97336__HA

SEQ ID NO: 11777 - RNA, 1701 nt, Artificial Sequence; identical to SEQ ID NO: 162
  derived and/or modified CDS sequence (AUadapt) from InfluenzaA__AHL97348__HA

SEQ ID NO: 11778 - RNA, 1701 nt, Artificial Sequence
  derived and/or modified CDS sequence (AUadapt) from InfluenzaA__AHL97372__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaacgccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11779 - RNA, 1701 nt, Artificial Sequence; identical to SEQ ID NO: 162
  derived and/or modified CDS sequence (AUadapt) from InfluenzaA__AHL97384__HA

SEQ ID NO: 11780 - RNA, 1701 nt, Artificial Sequence; identical to SEQ ID NO: 10103
  derived and/or modified CDS sequence (AUadapt) from InfluenzaA__AHL97396__HA

SEQ ID NO: 11781 - RNA, 1701 nt, Artificial Sequence; identical to SEQ ID NO: 10080
  derived and/or modified CDS sequence (AUadapt) from InfluenzaA__AHL97408__HA

SEQ ID NO: 11782 - RNA, 1701 nt, Artificial Sequence; identical to SEQ ID NO: 11751
  derived and/or modified CDS sequence (AUadapt) from InfluenzaA__AHL97420__HA

SEQ ID NO: 11783 - RNA, 1701 nt, Artificial Sequence
  derived and/or modified CDS sequence (AUadapt) from InfluenzaA__AHL97444__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacgggaccugcccccgguacgugaagcaguccacgcugaagcucgcgaccggcaugcgcaacguccccgagaagcagacccggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 11784 - RNA, 1701 nt, Artificial Sequence; identical to SEQ ID NO: 10113
  derived and/or modified CDS sequence (AUadapt) from InfluenzaA__AHL97456__HA

SEQ ID NO: 11785 - RNA, 1701 nt, Artificial Sequence
  derived and/or modified CDS sequence (AUadapt) from InfluenzaA__AHL97468__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugauggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 11786 - RNA, 1701 nt, Artificial Sequence; identical to SEQ ID NO: 162
  derived and/or modified CDS sequence (AUadapt) from InfluenzaA__AHL97480__HA

SEQ ID NO: 11787 - RNA, 1701 nt, Artificial Sequence; identical to SEQ ID NO: 162
  derived and/or modified CDS sequence (AUadapt) from InfluenzaA__AHL97493__HA

SEQ ID NO: 11788 - RNA, 1701 nt, Artificial Sequence; identical to SEQ ID NO: 11751
  derived and/or modified CDS sequence (AUadapt) from InfluenzaA__AHL97505__HA

SEQ ID NO: 11789 - RNA, 1701 nt, Artificial Sequence
  derived and/or modified CDS sequence (AUadapt) from InfluenzaA__AHL97517__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcacccagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11790 - RNA, 1701 nt, Artificial Sequence; identical to SEQ ID NO: 10128
  derived and/or modified CDS sequence (AUadapt) from InfluenzaA__AHL97529__HA

SEQ ID NO: 11791 - RNA, 1701 nt, Artificial Sequence; identical to SEQ ID NO: 10113
  derived and/or modified CDS sequence (AUadapt) from InfluenzaA__AHL97541__HA

SEQ ID NO: 11792 - RNA, 1701 nt, Artificial Sequence; identical to SEQ ID NO: 162
  derived and/or modified CDS sequence (AUadapt) from InfluenzaA__AHL97553__HA

SEQ ID NO: 11793 - RNA, 1701 nt, Artificial Sequence; identical to SEQ ID NO: 10080
  derived and/or modified CDS sequence (AUadapt) from InfluenzaA__AHL97565__HA

SEQ ID NO: 11794 - RNA, 1701 nt, Artificial Sequence
  derived and/or modified CDS sequence (AUadapt) from InfluenzaA__AHL97577__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcaacuccucguucuucucccgccugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccggccggaucaccgugucgaccaagcgcagccagcaggccgugaucccgaacaucggcucccggccccgcauccggaacauccccucgcgcaucuccaucuacuggacgaucgucaagcccggggacauccugcugaucaacagcaccggcaaccucaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgccugcccccgguacgugaagcaguccacgcugaagcuggcgaccgggaugcgcaacguccccgagaagcagacccggggcaucuucggggccaucgccggcuucaucgagaacggcugggaggggaugguggacggcugguacggguuccgccaccagaacagcgagggccgggggcaggccgccgaccucaaguccacccaggcggccaucgaccagaucaacggcaagcugaaccgccugaucggcaagacgaacgagaaguuccaccagaucgagaaggaguucucggagguggaggggcggauccaggaccucgagaaguacgucgaggacaccaagaucgaccugugguccuacaacgccgagcugcucguggcccuggagaaccagcacaccaucgaccugaccgacagcgagaugaacaagcuguucgagcgcacgaagaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagcccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 11795 - RNA, 1701 nt, Artificial Sequence; identical to SEQ ID NO: 10268
  derived and/or modified CDS sequence (AUadapt) from InfluenzaA__AHL97589__HA

SEQ ID NO: 11796 - RNA, 1701 nt, Artificial Sequence; identical to SEQ ID NO: 162
  derived and/or modified CDS sequence (AUadapt) from InfluenzaA__AHL97601__HA

SEQ ID NO: 11797 - RNA, 1701 nt, Artificial Sequence; identical to SEQ ID NO: 10103
  derived and/or modified CDS sequence (AUadapt) from InfluenzaA__AHL97613__HA

SEQ ID NO: 11798 - RNA, 1701 nt, Artificial Sequence; identical to SEQ ID NO: 11785
  derived and/or modified CDS sequence (AUadapt) from InfluenzaA__AHL97625__HA

SEQ ID NO: 11799 - RNA, 1701 nt, Artificial Sequence; identical to SEQ ID NO: 10113
  derived and/or modified CDS sequence (AUadapt) from InfluenzaA__AHL97637__HA

SEQ ID NO: 11800 - RNA, 1701 nt, Artificial Sequence
  derived and/or modified CDS sequence (AUadapt) from InfluenzaA__AHL97661__HA
augaagaccaucaucgcccugggcuacauccucugccugguguucgcccagaagcugcccgggaacgacaacucgaccgcgacgcucugccugggccaccacgccgucccgaacgggaccaucgugaagaccaucaccaacgaccgcaucgaggugacgaacgccaccgagcugguccagaacuccagcaucggcgagaucugcgacucgccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgucgcugcgcucccucgucgccagcuccgggacccuggaguucaacaacgagucguucaacuggacgggcgugacccagaacgggaccuccagcgccugcauccggcgcuccaacucguccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucgggccgcaucaccguguccaccaagcggagccagcaggccgugaucccgaacaucggcucgcgcccccggauccgcaacauccccucccggaucagcaucuacuggacgaucgucaagcccggggacauccugcucaucaacuccaccggcaaccugaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucaccuacggcgccugcccccgcuacgugaagcagagcacgcugaagcucgcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccugaaguccacccaggcggccaucgaccagaucaacggcaagcugaaccggcucaucggcaagacgaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacaacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 11801 - RNA, 1701 nt, Artificial Sequence
  derived and/or modified CDS sequence (AUadapt) from InfluenzaA__AHL97673__HA
augaagaccaccaucgcccugucguacauccucugccugguguucgcccaggagcugcccggcaacgacgacuccacggcgacccucugccuggggcaccacgccgucccgaacggcaccaucgugaagaccaucacgaacgaccagaucgaggugaccaacgccaccgagcugguccagucguccagcaccggggagaucugcaacucgccccaccagauccucgacggcgagaacugcacgcugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacccuggaguucaacaacgagucguucaacuggaccggggugacccagaacggcacguccagcgccugcauccgccgguccaacaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11802 - RNA, 1701 nt, Artificial Sequence; identical to SEQ ID NO: 162
  derived and/or modified CDS sequence (AUadapt) from InfluenzaA__AHL97685__HA

SEQ ID NO: 11803 - RNA, 1701 nt, Artificial Sequence
  derived and/or modified CDS sequence (AUadapt) from InfluenzaA__AHL97697__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcggggcaaggccuacuccaacugcuaccccuacgacgugccggacuacgcgagccugcgcucccucgucgccucguccgggacccuggaguucaacaacgagagcuucaacugggccggcgugacgcagaacgggaccuccucggccugcauccggggcuccaacagcuccuucuucucgcgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcucgcagcaggccgugaucccgaacaucgggagccggccccgcauccggaacauccccucccgcaucucgaucuacuggaccaucgucaagcccggcgacauccugcucaucaacuccacggggaaccugaucgccccgcggggcuacuucaagauccgcagcggcaaguccucgaucaugcgguccgacgcccccaucgggaagugcaagagcgagugcaucacccccaacggcuccauccccaacgacaagccguuccagaacgugaaccgcaucaccuacggggcgugcccccgguacgugaagcagucgacccugaagcucgccacgggcaugcgcaacguccccgagaagcagacccgggggaucuucggcgccaucgccggcuucaucgagaacgggugggagggcaugguggacgggugguacggcuuccgccaccagaacuccgaggggcggggccaggccgcggaccucaagagcacccaggccgccaucgaccagaucaacggcaagcugaaccgccugaucgggaagaccaacgagaaguuccaccagaucgagaaggaguucuccgagguggagggccggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcacguacgaccacgacguguaccgggacgaggcccucaacaaccgcuuccagaucaagggcgucgagcugaaguccggguacaaggacuggauccuguggaucagcuucgccaucuccugcuuccuccugugcguggcccugcucggcuucaucaugugggcgugccagaaggggaacauccggugcaacaucugcaucuga

SEQ ID NO: 11804 - RNA, 1701 nt, Artificial Sequence; identical to SEQ ID NO: 10113
  derived and/or modified CDS sequence (AUadapt) from InfluenzaA__AHL97709__HA

SEQ ID NO: 11805 - RNA, 1701 nt, Artificial Sequence; identical to SEQ ID NO: 162
  derived and/or modified CDS sequence (AUadapt) from InfluenzaA__AHL97721__HA

SEQ ID NO: 11806 - RNA, 1701 nt, Artificial Sequence; identical to SEQ ID NO: 10113
  derived and/or modified CDS sequence (AUadapt) from InfluenzaA__AHL97733__HA

SEQ ID NO: 11807 - RNA, 1701 nt, Artificial Sequence; identical to SEQ ID NO: 10103
  derived and/or modified CDS sequence (AUadapt) from InfluenzaA__AHL97745__HA

SEQ ID NO: 11808 - RNA, 1701 nt, Artificial Sequence; identical to SEQ ID NO: 162
  derived and/or modified CDS sequence (AUadapt) from InfluenzaA__AHL97757__HA

SEQ ID NO: 11809 - RNA, 1701 nt, Artificial Sequence; identical to SEQ ID NO: 162
  derived and/or modified CDS sequence (AUadapt) from InfluenzaA__AHL97769__HA

SEQ ID NO: 11810 - RNA, 1701 nt, Artificial Sequence
  derived and/or modified CDS sequence (AUadapt) from InfluenzaA__AHL97781__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaacuccagcaucaugcgguccgacgcccccaucggcaagugcaacucgacgugcaucacccccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 11811 - RNA, 1701 nt, Artificial Sequence; identical to SEQ ID NO: 162
  derived and/or modified CDS sequence (AUadapt) from InfluenzaA__AHL97793__HA

SEQ ID NO: 11812 - RNA, 1701 nt, Artificial Sequence
  derived and/or modified CDS sequence (AUadapt) from InfluenzaA__AHL97805__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacuacgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 11813 - RNA, 1701 nt, Artificial Sequence; identical to SEQ ID NO: 10113
  derived and/or modified CDS sequence (AUadapt) from InfluenzaA__AHL97817__HA

SEQ ID NO: 11814 - RNA, 1701 nt, Artificial Sequence; identical to SEQ ID NO: 11803
  derived and/or modified CDS sequence (AUadapt) from InfluenzaA__AHL97829__HA

SEQ ID NO: 11815 - RNA, 1701 nt, Artificial Sequence; identical to SEQ ID NO: 162
  derived and/or modified CDS sequence (AUadapt) from InfluenzaA__AHL97841__HA

SEQ ID NO: 11816 - RNA, 1701 nt, Artificial Sequence; identical to SEQ ID NO: 162
  derived and/or modified CDS sequence (AUadapt) from InfluenzaA__AHL97853__HA

SEQ ID NO: 11817 - RNA, 1701 nt, Artificial Sequence; identical to SEQ ID NO: 162
  derived and/or modified CDS sequence (AUadapt) from InfluenzaA__AHL97865__HA

SEQ ID NO: 11818 - RNA, 1701 nt, Artificial Sequence; identical to SEQ ID NO: 162
  derived and/or modified CDS sequence (AUadapt) from InfluenzaA__AHL97877__HA

SEQ ID NO: 11819 - RNA, 1701 nt, Artificial Sequence; identical to SEQ ID NO: 10113
  derived and/or modified CDS sequence (AUadapt) from InfluenzaA__AHL97889__HA

SEQ ID NO: 11820 - RNA, 1701 nt, Artificial Sequence; identical to SEQ ID NO: 10113
  derived and/or modified CDS sequence (AUadapt) from InfluenzaA__AHL97901__HA

SEQ ID NO: 11821 - RNA, 1701 nt, Artificial Sequence; identical to SEQ ID NO: 10103
  derived and/or modified CDS sequence (AUadapt) from InfluenzaA__AHL97913__HA

SEQ ID NO: 11822 - RNA, 1701 nt, Artificial Sequence
  derived and/or modified CDS sequence (AUadapt) from InfluenzaA__AHL97925__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacaccaucgaccugaccgacucggagaugaacaagcuguucgagaagacgaagaagcugcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 11823 - RNA, 1701 nt, Artificial Sequence; identical to SEQ ID NO: 10103
  derived and/or modified CDS sequence (AUadapt) from InfluenzaA__AHL97937__HA

SEQ ID NO: 11824 - RNA, 1701 nt, Artificial Sequence; identical to SEQ ID NO: 11783
  derived and/or modified CDS sequence (AUadapt) from InfluenzaA__AHL97949__HA

SEQ ID NO: 11825 - RNA, 1701 nt, Artificial Sequence; identical to SEQ ID NO: 10113
  derived and/or modified CDS sequence (AUadapt) from InfluenzaA__AHL97961__HA

SEQ ID NO: 11826 - RNA, 1701 nt, Artificial Sequence; identical to SEQ ID NO: 10113
  derived and/or modified CDS sequence (AUadapt) from InfluenzaA__AHL97973__HA

SEQ ID NO: 11827 - RNA, 1701 nt, Artificial Sequence; identical to SEQ ID NO: 10113
  derived and/or modified CDS sequence (AUadapt) from InfluenzaA__AHL97985__HA

SEQ ID NO: 11828 - RNA, 1701 nt, Artificial Sequence
  derived and/or modified CDS sequence (AUadapt) from InfluenzaA__AHL97997__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagauccgcggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11829 - RNA, 1701 nt, Artificial Sequence; identical to SEQ ID NO: 162
  derived and/or modified CDS sequence (AUadapt) from InfluenzaA__AHL98009__HA

SEQ ID NO: 11830 - RNA, 1701 nt, Artificial Sequence
  derived and/or modified CDS sequence (AUadapt) from InfluenzaA__AHL98021__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucgggaagaucugcgacucgccccaccagauccucgacggcgagaacugcacccugauggacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccggcgcagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccgggcgcaucaccgugagcaccaagcggucgcagcaggccgugaucccgaacaucggcucccgcccccggauccgcaacauccccagccggaucuccaucuacuggaccaucgucaagcccggcgacauccugcucaucaacucgacggggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggcgugcccccgcuacgugaagcaguccacccugaagcucgccacgggcaugcggaacguccccgagaagcagacccgcgggaucuucggcgccaucgccggguucaucgagaacggcugggagggcaugauggacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccggaacggcacguacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggcgugccagaaggggaacauccgcugcaacaucugcaucuga

SEQ ID NO: 11831 - RNA, 1701 nt, Artificial Sequence; identical to SEQ ID NO: 10113
  derived and/or modified CDS sequence (AUadapt) from InfluenzaA__AHL98033__HA

SEQ ID NO: 11832 - RNA, 1701 nt, Artificial Sequence; identical to SEQ ID NO: 11710
  derived and/or modified CDS sequence (AUadapt) from InfluenzaA__AHL98045__HA

SEQ ID NO: 11833 - RNA, 1701 nt, Artificial Sequence; identical to SEQ ID NO: 11710
  derived and/or modified CDS sequence (AUadapt) from InfluenzaA__AHL98057__HA

SEQ ID NO: 11834 - RNA, 1701 nt, Artificial Sequence; identical to SEQ ID NO: 11710
  derived and/or modified CDS sequence (AUadapt) from InfluenzaA__AHL98069__HA

SEQ ID NO: 11835 - RNA, 1701 nt, Artificial Sequence
  derived and/or modified CDS sequence (AUadapt) from InfluenzaA__AHL98081__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccgcaagagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcacccagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucgugggcaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11836 - RNA, 1701 nt, Artificial Sequence; identical to SEQ ID NO: 10103
  derived and/or modified CDS sequence (AUadapt) from InfluenzaA__AHL98093__HA

SEQ ID NO: 11837 - RNA, 1701 nt, Artificial Sequence
  derived and/or modified CDS sequence (AUadapt) from InfluenzaA__AHL98105__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcacgccggggcgaagggcuucuacaagaaccugaucuggcuggugaagaaggggaacagcuaccccaagcucuccaucucguacaucaacgacaagggcaaggaggugcugguccuguggggcauccaccaccccuccaccacggccgaccagcagucgcucuaccagaacgccgacaccuacguguucgugggggccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucgccauggagcgcaacgccggcucggggaucaucaucuccgacacccccgugcacgacugcaacacgaccugccagaccccgaagggcgccaucaacaccucgcuccccuuccagaacauccaccccaucaccaucgggaagugccccaaguacgugaaguccaccaagcugcggcuggcgacgggccuccgcaacgucccgagcauccagucccgggggcuguucggcgccaucgccggcuucaucgagggcggguggaccgggaugguggacggcugguacggguaccaccaccagaacgagcagggcucgggcuacgccgccgaccugaaguccacccagaacgcgaucgacaagaucaccaacaaggugaacucggucaucgagaagaugaacacgcaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgccgccucgucccugguccugguggugagccucggcgccaucuccuucuggaugugcucgaacgggagccugcagugccggaucugcaucuga

SEQ ID NO: 11838 - RNA, 1701 nt, Artificial Sequence; identical to SEQ ID NO: 10103
  derived and/or modified CDS sequence (AUadapt) from InfluenzaA__AHL98116__HA

SEQ ID NO: 11839 - RNA, 1701 nt, Artificial Sequence; identical to SEQ ID NO: 10113
  derived and/or modified CDS sequence (AUadapt) from InfluenzaA__AHL98128__HA

SEQ ID NO: 11840 - RNA, 1701 nt, Artificial Sequence; identical to SEQ ID NO: 10103
  derived and/or modified CDS sequence (AUadapt) from InfluenzaA__AHL98140__HA

SEQ ID NO: 11841 - RNA, 1701 nt, Artificial Sequence; identical to SEQ ID NO: 10103
  derived and/or modified CDS sequence (AUadapt) from InfluenzaA__AHL98152__HA

SEQ ID NO: 11842 - RNA, 1701 nt, Artificial Sequence; identical to SEQ ID NO: 10113
  derived and/or modified CDS sequence (AUadapt) from InfluenzaA__AHL98164__HA

SEQ ID NO: 11843 - RNA, 1701 nt, Artificial Sequence; identical to SEQ ID NO: 10113
  derived and/or modified CDS sequence (AUadapt) from InfluenzaA__AHL98176__HA

SEQ ID NO: 11844 - RNA, 1701 nt, Artificial Sequence; identical to SEQ ID NO: 10103
  derived and/or modified CDS sequence (AUadapt) from InfluenzaA__AHL98188__HA

SEQ ID NO: 11845 - RNA, 1701 nt, Artificial Sequence; identical to SEQ ID NO: 10268
  derived and/or modified CDS sequence (AUadapt) from InfluenzaA__AHL98200__HA

SEQ ID NO: 11846 - RNA, 1701 nt, Artificial Sequence; identical to SEQ ID NO: 10103
  derived and/or modified CDS sequence (AUadapt) from InfluenzaA__AHL98212__HA

SEQ ID NO: 11847 - RNA, 1701 nt, Artificial Sequence; identical to SEQ ID NO: 10103
  derived and/or modified CDS sequence (AUadapt) from InfluenzaA__AHL98224__HA

SEQ ID NO: 11848 - RNA, 1701 nt, Artificial Sequence; identical to SEQ ID NO: 162
  derived and/or modified CDS sequence (AUadapt) from InfluenzaA__AHL98236__HA

SEQ ID NO: 11849 - RNA, 1701 nt, Artificial Sequence; identical to SEQ ID NO: 10113
  derived and/or modified CDS sequence (AUadapt) from InfluenzaA__AHL98248__HA

SEQ ID NO: 11850 - RNA, 1701 nt, Artificial Sequence; identical to SEQ ID NO: 10103
  derived and/or modified CDS sequence (AUadapt) from InfluenzaA__AHL98260__HA

SEQ ID NO: 11851 - RNA, 1701 nt, Artificial Sequence; identical to SEQ ID NO: 10113
  derived and/or modified CDS sequence (AUadapt) from InfluenzaA__AHL98272__HA

SEQ ID NO: 11852 - RNA, 1701 nt, Artificial Sequence; identical to SEQ ID NO: 11709
  derived and/or modified CDS sequence (AUadapt) from InfluenzaA__AHL98284__HA

SEQ ID NO: 11853 - RNA, 1701 nt, Artificial Sequence
  derived and/or modified CDS sequence (AUadapt) from InfluenzaA__AHL98295__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacugggccggggugacgcagaacggcaccucguccgccugcauccgggggagcaacuccucguucuucucccgccugaacuggcugacccaccucaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcugaucaacucgacgggcaaccucaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcuggccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcucugcgucgcccugcugggguucaucaugugggcgugccagaagggcaacauccggugcaacaucugcaucuga

SEQ ID NO: 11854 - RNA, 1701 nt, Artificial Sequence; identical to SEQ ID NO: 11751
  derived and/or modified CDS sequence (AUadapt) from InfluenzaA__AHL98307__HA

SEQ ID NO: 11855 - RNA, 1701 nt, Artificial Sequence; identical to SEQ ID NO: 10113
  derived and/or modified CDS sequence (AUadapt) from InfluenzaA__AHL98319__HA

SEQ ID NO: 11856 - RNA, 1701 nt, Artificial Sequence; identical to SEQ ID NO: 10113
  derived and/or modified CDS sequence (AUadapt) from InfluenzaA__AHL98331__HA

SEQ ID NO: 11857 - RNA, 1701 nt, Artificial Sequence; identical to SEQ ID NO: 162
  derived and/or modified CDS sequence (AUadapt) from InfluenzaA__AHL98343__HA

SEQ ID NO: 11858 - RNA, 1701 nt, Artificial Sequence; identical to SEQ ID NO: 11751
  derived and/or modified CDS sequence (AUadapt) from InfluenzaA__AHL98354__HA

SEQ ID NO: 11859 - RNA, 1701 nt, Artificial Sequence; identical to SEQ ID NO: 10103
  derived and/or modified CDS sequence (AUadapt) from InfluenzaA__AHL98366__HA

SEQ ID NO: 11860 - RNA, 1701 nt, Artificial Sequence; identical to SEQ ID NO: 10103
  derived and/or modified CDS sequence (AUadapt) from InfluenzaA__AHL98378__HA

SEQ ID NO: 11861 - RNA, 1701 nt, Artificial Sequence; identical to SEQ ID NO: 10103
  derived and/or modified CDS sequence (AUadapt) from InfluenzaA__AHL98390__HA

SEQ ID NO: 11862 - RNA, 1701 nt, Artificial Sequence; identical to SEQ ID NO: 10103
  derived and/or modified CDS sequence (AUadapt) from InfluenzaA__AHL98402__HA

SEQ ID NO: 11863 - RNA, 1701 nt, Artificial Sequence; identical to SEQ ID NO: 10113
  derived and/or modified CDS sequence (AUadapt) from InfluenzaA__AHL98414__HA

SEQ ID NO: 11864 - RNA, 1701 nt, Artificial Sequence
  derived and/or modified CDS sequence (AUadapt) from InfluenzaA__AHL98426__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccaggugaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 11865 - RNA, 1701 nt, Artificial Sequence; identical to SEQ ID NO: 10285
  derived and/or modified CDS sequence (AUadapt) from InfluenzaA__AHL98438__HA

SEQ ID NO: 11866 - RNA, 1701 nt, Artificial Sequence; identical to SEQ ID NO: 10285
  derived and/or modified CDS sequence (AUadapt) from InfluenzaA__AHL98449__HA

SEQ ID NO: 11867 - RNA, 1701 nt, Artificial Sequence
  derived and/or modified CDS sequence (AUadapt) from InfluenzaA__AHL98471__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagaaguucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugcgcgaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccggguccggcaucaucaucucggacacccccguccacgacugcaacacgaccugccagaccccggagggcgccaucaacaccucccugcccuuccagaacauccaccccaucaccaucgggaagugccccaaguacgucaagucgaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggagaagaucgacggcgugaagcucgaguccacccgcaucuaccagauccuggcgaucuacucgaccguggccuccagccugguccucguggugucccugggggccaucucguucuggaugugcagcaacggcucccugcagugccggaucugcaucuga

SEQ ID NO: 11868 - RNA, 1701 nt, Artificial Sequence; identical to SEQ ID NO: 162
  derived and/or modified CDS sequence (AUadapt) from InfluenzaA__AHL98482__HA

SEQ ID NO: 11869 - RNA, 1701 nt, Artificial Sequence; identical to SEQ ID NO: 10080
  derived and/or modified CDS sequence (AUadapt) from InfluenzaA__AHL98494__HA

SEQ ID NO: 11870 - RNA, 1701 nt, Artificial Sequence; identical to SEQ ID NO: 162
  derived and/or modified CDS sequence (AUadapt) from InfluenzaA__AHL98506__HA

SEQ ID NO: 11871 - RNA, 1701 nt, Artificial Sequence; identical to SEQ ID NO: 162
  derived and/or modified CDS sequence (AUadapt) from InfluenzaA__AHL98518__HA

SEQ ID NO: 11872 - RNA, 1701 nt, Artificial Sequence; identical to SEQ ID NO: 10080
  derived and/or modified CDS sequence (AUadapt) from InfluenzaA__AHL98530__HA

SEQ ID NO: 11873 - RNA, 1701 nt, Artificial Sequence; identical to SEQ ID NO: 162
  derived and/or modified CDS sequence (AUadapt) from InfluenzaA__AHL98542__HA

SEQ ID NO: 11874 - RNA, 1701 nt, Artificial Sequence; identical to SEQ ID NO: 162
  derived and/or modified CDS sequence (AUadapt) from InfluenzaA__AHL98554__HA

SEQ ID NO: 11875 - RNA, 1701 nt, Artificial Sequence; identical to SEQ ID NO: 10113
  derived and/or modified CDS sequence (AUadapt) from InfluenzaA__AHL98566__HA

SEQ ID NO: 11876 - RNA, 1701 nt, Artificial Sequence; identical to SEQ ID NO: 10113
  derived and/or modified CDS sequence (AUadapt) from InfluenzaA__AHL98578__HA

SEQ ID NO: 11877 - RNA, 1701 nt, Artificial Sequence; identical to SEQ ID NO: 162
  derived and/or modified CDS sequence (AUadapt) from InfluenzaA__AHL98590__HA

SEQ ID NO: 11878 - RNA, 1701 nt, Artificial Sequence; identical to SEQ ID NO: 10103
  derived and/or modified CDS sequence (AUadapt) from InfluenzaA__AHL98602__HA

SEQ ID NO: 11879 - RNA, 1701 nt, Artificial Sequence; identical to SEQ ID NO: 10080
  derived and/or modified CDS sequence (AUadapt) from InfluenzaA__AHL98614__HA

SEQ ID NO: 11880 - RNA, 1701 nt, Artificial Sequence
  derived and/or modified CDS sequence (AUadapt) from InfluenzaA__AHL98626__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagcgcugggaccuguucguggagcggucgaaggcccacuccaacugcuaccccuacgacgugccggacuacgcgagccugcgcucccucgucgccucguccggcacgcuggaguucaacaacgagagcuucaacuggaccggggugacccagaacggcaccuccucggccugcauccggcgcuccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 11881 - RNA, 1701 nt, Artificial Sequence; identical to SEQ ID NO: 10103
  derived and/or modified CDS sequence (AUadapt) from InfluenzaA__AHL98638__HA

SEQ ID NO: 11882 - RNA, 1701 nt, Artificial Sequence; identical to SEQ ID NO: 10113
  derived and/or modified CDS sequence (AUadapt) from InfluenzaA__AHL98650__HA

SEQ ID NO: 11883 - RNA, 1701 nt, Artificial Sequence
  derived and/or modified CDS sequence (AUadapt) from InfluenzaA__AHL98662__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccacuccaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugauggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggagguggagggccgcauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaaggggguggagcucaagucgggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 11884 - RNA, 1701 nt, Artificial Sequence; identical to SEQ ID NO: 11751
  derived and/or modified CDS sequence (AUadapt) from InfluenzaA__AHL98674__HA

SEQ ID NO: 11885 - RNA, 1701 nt, Artificial Sequence; identical to SEQ ID NO: 10103
  derived and/or modified CDS sequence (AUadapt) from InfluenzaA__AHL98686__HA

SEQ ID NO: 11886 - RNA, 1701 nt, Artificial Sequence; identical to SEQ ID NO: 162
  derived and/or modified CDS sequence (AUadapt) from InfluenzaA__AHL98699__HA

SEQ ID NO: 11887 - RNA, 1701 nt, Artificial Sequence; identical to SEQ ID NO: 10368
  derived and/or modified CDS sequence (AUadapt) from InfluenzaA__AHL98711__HA

SEQ ID NO: 11888 - RNA, 1701 nt, Artificial Sequence; identical to SEQ ID NO: 10712
  derived and/or modified CDS sequence (AUadapt) from InfluenzaA__AHL98722__HA

SEQ ID NO: 11889 - RNA, 1701 nt, Artificial Sequence; identical to SEQ ID NO: 10113
  derived and/or modified CDS sequence (AUadapt) from InfluenzaA__AHL98734__HA

SEQ ID NO: 11890 - RNA, 1701 nt, Artificial Sequence; identical to SEQ ID NO: 162
  derived and/or modified CDS sequence (AUadapt) from InfluenzaA__AHL98746__HA

SEQ ID NO: 11891 - RNA, 1701 nt, Artificial Sequence; identical to SEQ ID NO: 10113
  derived and/or modified CDS sequence (AUadapt) from InfluenzaA__AHL98758__HA

SEQ ID NO: 11892 - RNA, 1701 nt, Artificial Sequence; identical to SEQ ID NO: 10103
  derived and/or modified CDS sequence (AUadapt) from InfluenzaA__AHL98770__HA

SEQ ID NO: 11893 - RNA, 1701 nt, Artificial Sequence; identical to SEQ ID NO: 10242
  derived and/or modified CDS sequence (AUadapt) from InfluenzaA__AHL98782__HA

SEQ ID NO: 11894 - RNA, 1701 nt, Artificial Sequence
  derived and/or modified CDS sequence (AUadapt) from InfluenzaA__AHL98794__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugccgcuccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 11895 - RNA, 1701 nt, Artificial Sequence
  derived and/or modified CDS sequence (AUadapt) from InfluenzaA__AHL98806__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccagaccgccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 11896 - RNA, 1701 nt, Artificial Sequence; identical to SEQ ID NO: 10103
  derived and/or modified CDS sequence (AUadapt) from InfluenzaA__AHL98818__HA

SEQ ID NO: 11897 - RNA, 1701 nt, Artificial Sequence; identical to SEQ ID NO: 10113
  derived and/or modified CDS sequence (AUadapt) from InfluenzaA__AHL98830__HA

SEQ ID NO: 11898 - RNA, 1701 nt, Artificial Sequence; identical to SEQ ID NO: 10103
  derived and/or modified CDS sequence (AUadapt) from InfluenzaA__AHL98842__HA

SEQ ID NO: 11899 - RNA, 1701 nt, Artificial Sequence; identical to SEQ ID NO: 10103
  derived and/or modified CDS sequence (AUadapt) from InfluenzaA__AHL98854__HA

SEQ ID NO: 11900 - RNA, 1701 nt, Artificial Sequence
  derived and/or modified CDS sequence (AUadapt) from InfluenzaA__AHL98878__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcucgcucgucgcguccagcggcacgcuggaguucaacaacgaguccuucaacuggaccggggugacccagaacggcaccucguccgccugcauccggcgcagcaacuccucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggucgcagcaggcggugaucccgaacaucggcucccgcccccggauccgcaacauccccagccggaucuccaucuacuggaccaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacucggaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacaacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11901 - RNA, 1701 nt, Artificial Sequence
  derived and/or modified CDS sequence (AUadapt) from InfluenzaA__AHL98890__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagucgggcuacaaggacuggauccuguggaucuccuucgccaucagcugccugcugcugugcguggcccuccugggguucaucaugugggcgugccagaagggcaacauccggugcaacaucugcaucuga

SEQ ID NO: 11902 - RNA, 1701 nt, Artificial Sequence
  derived and/or modified CDS sequence (AUadapt) from InfluenzaA__AHL98902__HA
augaagaccaucaucgcccugucguacauccucugccugguguucgcccagaagcugcccggcaacgacaacuccaccgcgacgcucugccuggggcaccacgccgucccgaacggcaccguggugaagaccaucaccaacgaccgcaucgaggucacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgucccggacuacgcgucccugcgcucgcucguggccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgucaccaugcccaacaacgagcaguucgacaagcucuacaucuggggcgugcaccaccccgggacggacaaggaccagaucuuccuguacgcccagagcuccggccggaucaccgugagcaccaagcgcucgcagcaggccgucaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgucaagcaguccacccugaagcucgccacggggaugcgcaacgugcccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgaggucgaggggcggauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11903 - RNA, 1701 nt, Artificial Sequence; identical to SEQ ID NO: 10113
  derived and/or modified CDS sequence (AUadapt) from InfluenzaA__AHL98913__HA

SEQ ID NO: 11904 - RNA, 1701 nt, Artificial Sequence; identical to SEQ ID NO: 10103
  derived and/or modified CDS sequence (AUadapt) from InfluenzaA__AHL98925__HA

SEQ ID NO: 11905 - RNA, 1701 nt, Artificial Sequence; identical to SEQ ID NO: 10242
  derived and/or modified CDS sequence (AUadapt) from InfluenzaA__AHL98937__HA

SEQ ID NO: 11906 - RNA, 1701 nt, Artificial Sequence; identical to SEQ ID NO: 162
  derived and/or modified CDS sequence (AUadapt) from InfluenzaA__AHL98961__HA

SEQ ID NO: 11907 - RNA, 1701 nt, Artificial Sequence
  derived and/or modified CDS sequence (AUadapt) from InfluenzaA__AHL98973__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccguggucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 11908 - RNA, 1701 nt, Artificial Sequence
  derived and/or modified CDS sequence (AUadapt) from InfluenzaA__AHL98985__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcaccaucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacugggccggggugacgcagaacggcaccucguccgccugcauccgggggagcaacuccucguucuucucccgccugaacuggcugacccaccucaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcugaucaacucgacgggcaaccucaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 11909 - RNA, 1701 nt, Artificial Sequence; identical to SEQ ID NO: 162
  derived and/or modified CDS sequence (AUadapt) from InfluenzaA__AHL98997__HA

SEQ ID NO: 11910 - RNA, 1701 nt, Artificial Sequence; identical to SEQ ID NO: 10103
  derived and/or modified CDS sequence (AUadapt) from InfluenzaA__AHL99009__HA

SEQ ID NO: 11911 - RNA, 1701 nt, Artificial Sequence; identical to SEQ ID NO: 10113
  derived and/or modified CDS sequence (AUadapt) from InfluenzaA__AHL99021__HA

SEQ ID NO: 11912 - RNA, 1701 nt, Artificial Sequence
  derived and/or modified CDS sequence (AUadapt) from InfluenzaA__AHL99045__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcaacuccucguucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacgggcccugcccccgcuacgugaagcaguccacgcugaagcuggccaccggcaugcggaacguccccgagaagcagacccgcgggaucuucggcgcgaucgccggguucaucgagaacggcugggagggcaugguggacgggugguacggcuuccggcaccagaacucggaggggcgcggccaggccgccgaccucaaguccacccaggccgcgaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 11913 - RNA, 1701 nt, Artificial Sequence
  derived and/or modified CDS sequence (AUadapt) from InfluenzaA__AHL99057__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagaucaucgacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacugggccggggugacgcagaacggcaccucguccgccugcauccgggggagcaacuccucguucuucucccgccugaacuggcugacccaccucaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcugaucaacucgacgggcaaccucaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 11914 - RNA, 1701 nt, Artificial Sequence
  derived and/or modified CDS sequence (AUadapt) from InfluenzaA__AHL99069__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacacgcugcucaucaacagcaccggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucucggagguggaggggcggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacaacguguaccgggacgaggcccucaacaaccgcuuccagaucaagggcgucgagcucaagucgggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 11915 - RNA, 1701 nt, Artificial Sequence
  derived and/or modified CDS sequence (AUadapt) from InfluenzaA__AHL99081__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcagggcacgcugaagcucgcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagacgaacgagaaguuccaccagaucgagaaggaguucuccgagguggaggggcgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacaugggcaacgggugcuucaagaucuaccacaagugcgacaacgcgugcaucggcagcauccggaacgggaccuacgaccacaacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 11916 - RNA, 1701 nt, Artificial Sequence
  derived and/or modified CDS sequence (AUadapt) from InfluenzaA__AHL99093__HA
augaagaccaucaucgcccugucguacauccucugccugaucuucgcccagaagcugcccggcaacgacaacuccaccgcgacgcucugccuggggcaccacgccgugccgaacggcaccaucgucaagaccaucaccaacgaccgcaucgaggugacgaacgccaccgagcuggugcagaacagcuccaucggggagaucugcgacucgccccaccagauccucgacggcgagaacugcacccugaucgacgcccugcucggggacccccagugcgacggcuuccagaacaagaagugggaccuguucgucgagcgguccaaggccuacagcaacugcuaccccuacgacgugccggacuacgcgucccugcgcucgcucguggccuccagcggcacccuggaguucaacaacgaguccuucaacuggacgggggucacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcgugcaccaccccgggaccgacaaggaccagaucuuccuguacgcgcagagcuccgggcgcaucaccgucagcaccaagcggucgcagcaggccgugaucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgucaaccggaucaccuacggggccugcccccgcuacgugaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacaucaagugcaacaucugcaucuga

SEQ ID NO: 11917 - RNA, 1701 nt, Artificial Sequence; identical to SEQ ID NO: 10103
  derived and/or modified CDS sequence (AUadapt) from InfluenzaA__AHL99117__HA

SEQ ID NO: 11918 - RNA, 1701 nt, Artificial Sequence
  derived and/or modified CDS sequence (AUadapt) from InfluenzaA__AHL99129__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggacaucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaucugggccugccagaaggggaacauccgcugcaacaucugcaucuga

SEQ ID NO: 11919 - RNA, 1701 nt, Artificial Sequence
  derived and/or modified CDS sequence (AUadapt) from InfluenzaA__AHL99141__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacuccucguucuucucccgccugaacuggcucacccaccuggacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11920 - RNA, 1701 nt, Artificial Sequence
  derived and/or modified CDS sequence (AUadapt) from InfluenzaA__AHL99153__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaccccgaacaucggcucccggccccgcauccgggacauccccucgcgcaucuccaucuacuggacgaucgucaagcccggggacauccugcucaucaacagcaccggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucucggagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11921 - RNA, 1701 nt, Artificial Sequence; identical to SEQ ID NO: 10242
  derived and/or modified CDS sequence (AUadapt) from InfluenzaA__AHL99165__HA

SEQ ID NO: 11922 - RNA, 1701 nt, Artificial Sequence; identical to SEQ ID NO: 10727
  derived and/or modified CDS sequence (AUadapt) from InfluenzaA__AHL99177__HA

SEQ ID NO: 11923 - RNA, 1701 nt, Artificial Sequence; identical to SEQ ID NO: 10103
  derived and/or modified CDS sequence (AUadapt) from InfluenzaA__AHL99189__HA

SEQ ID NO: 11924 - RNA, 1701 nt, Artificial Sequence; identical to SEQ ID NO: 162
  derived and/or modified CDS sequence (AUadapt) from InfluenzaA__AHL99225__HA

SEQ ID NO: 11925 - RNA, 1701 nt, Artificial Sequence; identical to SEQ ID NO: 10712
  derived and/or modified CDS sequence (AUadapt) from InfluenzaA__AHL99237__HA

SEQ ID NO: 11926 - RNA, 1701 nt, Artificial Sequence; identical to SEQ ID NO: 10113
  derived and/or modified CDS sequence (AUadapt) from InfluenzaA__AHL99249__HA

SEQ ID NO: 11927 - RNA, 1701 nt, Artificial Sequence; identical to SEQ ID NO: 10103
  derived and/or modified CDS sequence (AUadapt) from InfluenzaA__AHL99261__HA

SEQ ID NO: 11928 - RNA, 1701 nt, Artificial Sequence; identical to SEQ ID NO: 10242
  derived and/or modified CDS sequence (AUadapt) from InfluenzaA__AHL99273__HA

SEQ ID NO: 11929 - RNA, 1701 nt, Artificial Sequence
  derived and/or modified CDS sequence (AUadapt) from InfluenzaA__AHL99285__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccaguccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11930 - RNA, 1701 nt, Artificial Sequence; identical to SEQ ID NO: 10268
  derived and/or modified CDS sequence (AUadapt) from InfluenzaA__AHL99297__HA

SEQ ID NO: 11931 - RNA, 1701 nt, Artificial Sequence; identical to SEQ ID NO: 10113
  derived and/or modified CDS sequence (AUadapt) from InfluenzaA__AHL99309__HA

SEQ ID NO: 11932 - RNA, 1701 nt, Artificial Sequence
  derived and/or modified CDS sequence (AUadapt) from InfluenzaA__AHL99321__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgccucccugcggucgcucgucgcguccagcggcacgcuggaguucaacaacgaguccuucaacugggccggggugacccagaacggcaccucguccgccugcauccgcgggagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugagcaccaagcggucgcagcaggccgugaucccgaacaucggcucccgcccccggauccgcaacauccccagccggaucuccaucuacuggacgaucgucaagcccggggacauccugcucaucaacucgaccggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 11933 - RNA, 1701 nt, Artificial Sequence
  derived and/or modified CDS sequence (AUadapt) from InfluenzaA__AHL99333__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacaacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 11934 - RNA, 1701 nt, Artificial Sequence
  derived and/or modified CDS sequence (AUadapt) from InfluenzaA__AHL99356__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgaaguacuccaagaaguucaagcccgagaucgccauccggccgaagguccgcgaccaggagggccggaugaacuacuacuggacccugaucgagcccggggacaagaucaccuucgaggcgacgggcaaccucguggugccccgcuacgccuucgccauggagcggaacgccgggucgggcaucaucaucuccgacacccccguccacgacugcaacacgaccugccagaccccggagggcgccaucaacaccagccugcccuuccagaacauccaccccaucaccaucgggaagugccccaaguacgugaaguccaccaagcugcgccucgcgacgggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 11935 - RNA, 1701 nt, Artificial Sequence; identical to SEQ ID NO: 10128
  derived and/or modified CDS sequence (AUadapt) from InfluenzaA__AHL99367__HA

SEQ ID NO: 11936 - RNA, 1701 nt, Artificial Sequence
  derived and/or modified CDS sequence (AUadapt) from InfluenzaA__AHL99379__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcacgccggggcgaagggcuucuacaagaaccugaucuggcuggugaagaaggggaacagcuaccccaagcucuccaucucguacaucaacgacaagggcaaggaggugcugguccuguggggcauccaccaccccuccaccacggccgaccagcagucgcucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgccaucuacuccaccgcggccucgucccugguccugguggugagccucggcgccaucuccuucuggaugugcucgaacgggagccugcagugccggaucugcaucuga

SEQ ID NO: 11937 - RNA, 1701 nt, Artificial Sequence; identical to SEQ ID NO: 11929
  derived and/or modified CDS sequence (AUadapt) from InfluenzaA__AHL99390__HA

SEQ ID NO: 11938 - RNA, 1701 nt, Artificial Sequence; identical to SEQ ID NO: 10103
  derived and/or modified CDS sequence (AUadapt) from InfluenzaA__AHL99402__HA

SEQ ID NO: 11939 - RNA, 1701 nt, Artificial Sequence
  derived and/or modified CDS sequence (AUadapt) from InfluenzaA__AHL99426__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaugaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 11940 - RNA, 1701 nt, Artificial Sequence
  derived and/or modified CDS sequence (AUadapt) from InfluenzaA__AHL99438__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccaguccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 11941 - RNA, 1701 nt, Artificial Sequence; identical to SEQ ID NO: 162
  derived and/or modified CDS sequence (AUadapt) from InfluenzaA__AHL99450__HA

SEQ ID NO: 11942 - RNA, 1701 nt, Artificial Sequence; identical to SEQ ID NO: 10712
  derived and/or modified CDS sequence (AUadapt) from InfluenzaA__AHL99462__HA

SEQ ID NO: 11943 - RNA, 1701 nt, Artificial Sequence; identical to SEQ ID NO: 10242
  derived and/or modified CDS sequence (AUadapt) from InfluenzaA__AHL99474__HA

SEQ ID NO: 11944 - RNA, 1701 nt, Artificial Sequence; identical to SEQ ID NO: 10268
  derived and/or modified CDS sequence (AUadapt) from InfluenzaA__AHL99486__HA

SEQ ID NO: 11945 - RNA, 1701 nt, Artificial Sequence; identical to SEQ ID NO: 162
  derived and/or modified CDS sequence (AUadapt) from InfluenzaA__AHL99498__HA

SEQ ID NO: 11946 - RNA, 1701 nt, Artificial Sequence; identical to SEQ ID NO: 10103
  derived and/or modified CDS sequence (AUadapt) from InfluenzaA__AHL99510__HA

SEQ ID NO: 11947 - RNA, 1701 nt, Artificial Sequence; identical to SEQ ID NO: 10103
  derived and/or modified CDS sequence (AUadapt) from InfluenzaA__AHL99522__HA

SEQ ID NO: 11948 - RNA, 1701 nt, Artificial Sequence; identical to SEQ ID NO: 10128
  derived and/or modified CDS sequence (AUadapt) from InfluenzaA__AHL99534__HA

SEQ ID NO: 11949 - RNA, 1701 nt, Artificial Sequence; identical to SEQ ID NO: 10103
  derived and/or modified CDS sequence (AUadapt) from InfluenzaA__AHL99546__HA

SEQ ID NO: 11950 - RNA, 1701 nt, Artificial Sequence; identical to SEQ ID NO: 10103
  derived and/or modified CDS sequence (AUadapt) from InfluenzaA__AHL99558__HA

SEQ ID NO: 11951 - RNA, 1701 nt, Artificial Sequence
  derived and/or modified CDS sequence (AUadapt) from InfluenzaA__AHL99570__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcuccugcuaccccuacgacgugccggacuacgcgucgcugcgcucccucgucgccagcuccggcacccuggaguucaacaacgagucguucaacuggacgggggugacccagaacggcaccuccagcgccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccgugucgaccaagcggucccagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacaucaagcagagcacgcugaagcucgcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 11952 - RNA, 1701 nt, Artificial Sequence; identical to SEQ ID NO: 10103
  derived and/or modified CDS sequence (AUadapt) from InfluenzaA__AHL99582__HA

SEQ ID NO: 11953 - RNA, 1701 nt, Artificial Sequence
  derived and/or modified CDS sequence (AUadapt) from InfluenzaA__AHL99594__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcgggccggggcgaagggcuucuacaagaaccugaucuggcuggugaagaaggggaacagcuaccccaagcucuccaucucguacaucaacgacaagggcaaggaggugcugguccuguggggcauccaccaccccuccaccacggccgaccagcagucgcucuaccagaacgccgacaccuacguguucguggggaccagccgcuacuccaagaaguucaagcccgagaucgccauccggccgaagguccgcgaccaggagggccggaugaacuacuacuggacccugguggagcccggggacaagaucacguucgaggccaccggcaaccugguggucccccgcuacgcguucgccauggagcggaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcgccuggccaccggccuccggaacgucccgagcauccagucccgcgggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccaguucaccgcgguggggaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagucgacccggaucuaccagauccucgccaucuacuccaccgcggccucgucccugguccugguggugagccucggcgccaucuccuucuggaugugcucgaacgggagccugcagugccgcaucugcaucuga

SEQ ID NO: 11954 - RNA, 1701 nt, Artificial Sequence; identical to SEQ ID NO: 10712
  derived and/or modified CDS sequence (AUadapt) from InfluenzaA__AHL99605__HA

SEQ ID NO: 11955 - RNA, 1701 nt, Artificial Sequence; identical to SEQ ID NO: 10242
  derived and/or modified CDS sequence (AUadapt) from InfluenzaA__AHL99617__HA

SEQ ID NO: 11956 - RNA, 1701 nt, Artificial Sequence; identical to SEQ ID NO: 10103
  derived and/or modified CDS sequence (AUadapt) from InfluenzaA__AHL99629__HA

SEQ ID NO: 11957 - RNA, 1701 nt, Artificial Sequence
  derived and/or modified CDS sequence (AUadapt) from InfluenzaA__AHL99641__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccguggucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacaaccacgacgucuaccgcgacgaggcccucaacaaccgguuccagaucaaggggguggagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 11958 - RNA, 1701 nt, Artificial Sequence
  derived and/or modified CDS sequence (AUadapt) from InfluenzaA__AHL99665__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacaucaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 11959 - RNA, 1701 nt, Artificial Sequence; identical to SEQ ID NO: 10103
  derived and/or modified CDS sequence (AUadapt) from InfluenzaA__AHL99677__HA

SEQ ID NO: 11960 - RNA, 1701 nt, Artificial Sequence; identical to SEQ ID NO: 10103
  derived and/or modified CDS sequence (AUadapt) from InfluenzaA__AHL99689__HA

SEQ ID NO: 11961 - RNA, 1701 nt, Artificial Sequence
  derived and/or modified CDS sequence (AUadapt) from InfluenzaA__AHL99701__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaccccgaacaucggcucccggccccgcauccggaacauccccucgcgcaucuccaucuacuggacgaucgucaagcccggggacauccugcucaucaacagcaccggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacgcugaagcucgccaccgggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccaggccgccaucgaccagaucaacggcaagcugaaccgccucaucggcaagacgaacgagaaguuccaccagaucgagaaggaguucucggagguggaggggcggauccaggaccuggagaaguacguggaggacaccaagaucgaccugugguccuacaacgccgagcuccuggucgcccuggagaaccagcacaccaucgaccucaccgacagcgagaugaacaagcuguucgagaagacgaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11962 - RNA, 1701 nt, Artificial Sequence
  derived and/or modified CDS sequence (AUadapt) from InfluenzaA__AHL99713__HA
augaagaccaucaucgcccugucguacauccucugccugguguucgcccagaagcugcccggcaacgacaacuccaccgcgacccucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacaccucccugcgcucgcucgucgcguccagcggcacgcuggaguucaacaacgaguccuucaacuggaccggggugacccagaacggcaccucguccgccugcauccggcgcagcaacuccucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugucgacgaagcggagccagcaggcggugaucccgaacaucggcucccgcccccggauccgcaacauccccucgcggaucuccaucuacuggaccaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacagcgaggggcgcggccaggccgccgaccugaaguccacgcaggccgcgaucgaccagaucaacgggaagcugaaccggcucaucggcaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggggucgagcucaagagcggcuacaaggacuggauccuguggaucuccuucgccaucacgugcuuccugcugugcguggcccugcucggcuucaucaugugggccugccagaaggggaacauccgcugcaacaucugcaucuga

SEQ ID NO: 11963 - RNA, 1701 nt, Artificial Sequence; identical to SEQ ID NO: 10103
  derived and/or modified CDS sequence (AUadapt) from InfluenzaA__AHL99725__HA

SEQ ID NO: 11964 - RNA, 1701 nt, Artificial Sequence; identical to SEQ ID NO: 10305
  derived and/or modified CDS sequence (AUadapt) from InfluenzaA__AHL99737__HA

SEQ ID NO: 11965 - RNA, 1701 nt, Artificial Sequence; identical to SEQ ID NO: 10103
  derived and/or modified CDS sequence (AUadapt) from InfluenzaA__AHL99748__HA

SEQ ID NO: 11966 - RNA, 1701 nt, Artificial Sequence; identical to SEQ ID NO: 10103
  derived and/or modified CDS sequence (AUadapt) from InfluenzaA__AHL99760__HA

SEQ ID NO: 11967 - RNA, 1701 nt, Artificial Sequence; identical to SEQ ID NO: 10113
  derived and/or modified CDS sequence (AUadapt) from InfluenzaA__AHL99772__HA

SEQ ID NO: 11968 - RNA, 1701 nt, Artificial Sequence; identical to SEQ ID NO: 10128
  derived and/or modified CDS sequence (AUadapt) from InfluenzaA__AHL99784__HA

SEQ ID NO: 11969 - RNA, 1701 nt, Artificial Sequence; identical to SEQ ID NO: 10268
  derived and/or modified CDS sequence (AUadapt) from InfluenzaA__AHL99796__HA

SEQ ID NO: 11970 - RNA, 1701 nt, Artificial Sequence; identical to SEQ ID NO: 10103
  derived and/or modified CDS sequence (AUadapt) from InfluenzaA__AHL99808__HA

SEQ ID NO: 11971 - RNA, 1701 nt, Artificial Sequence
  derived and/or modified CDS sequence (AUadapt) from InfluenzaA__AHL99820__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggacgggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggugcugcucggcuucaucaugugggccugccagaaggggaacauccgcugcaacaucugcaucuga

SEQ ID NO: 11972 - RNA, 1701 nt, Artificial Sequence; identical to SEQ ID NO: 10103
  derived and/or modified CDS sequence (AUadapt) from InfluenzaA__AHL99832__HA

SEQ ID NO: 11973 - RNA, 1701 nt, Artificial Sequence; identical to SEQ ID NO: 10128
  derived and/or modified CDS sequence (AUadapt) from InfluenzaA__AHL99844__HA

SEQ ID NO: 11974 - RNA, 1701 nt, Artificial Sequence; identical to SEQ ID NO: 10080
  derived and/or modified CDS sequence (AUadapt) from InfluenzaA__AHL99856__HA

SEQ ID NO: 11975 - RNA, 1701 nt, Artificial Sequence
  derived and/or modified CDS sequence (AUadapt) from InfluenzaA__AHL99868__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucucggagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcucaagucgggcuacaaggacuggauccuguggaucuccuucgccaucagcugcuuccugcugugcgucgcgcugcucggcuucaucaugugggccugccagaaggggaacauccgcugcaacaucugcaucuga

SEQ ID NO: 11976 - RNA, 1701 nt, Artificial Sequence; identical to SEQ ID NO: 10242
  derived and/or modified CDS sequence (AUadapt) from InfluenzaA__AHL99880__HA

SEQ ID NO: 11977 - RNA, 1701 nt, Artificial Sequence; identical to SEQ ID NO: 10103
  derived and/or modified CDS sequence (AUadapt) from InfluenzaA__AHL99892__HA

SEQ ID NO: 11978 - RNA, 1701 nt, Artificial Sequence; identical to SEQ ID NO: 162
  derived and/or modified CDS sequence (AUadapt) from InfluenzaA__AHL99904__HA

SEQ ID NO: 11979 - RNA, 1701 nt, Artificial Sequence
  derived and/or modified CDS sequence (AUadapt) from InfluenzaA__AHL99916__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagaugcgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 11980 - RNA, 1701 nt, Artificial Sequence; identical to SEQ ID NO: 10128
  derived and/or modified CDS sequence (AUadapt) from InfluenzaA__AHL99928__HA

SEQ ID NO: 11981 - RNA, 1701 nt, Artificial Sequence
  derived and/or modified CDS sequence (AUadapt) from InfluenzaA__AHL99940__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcggcguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 11982 - RNA, 1701 nt, Artificial Sequence; identical to SEQ ID NO: 10103
  derived and/or modified CDS sequence (AUadapt) from InfluenzaA__AHL99952__HA

SEQ ID NO: 11983 - RNA, 1701 nt, Artificial Sequence; identical to SEQ ID NO: 10128
  derived and/or modified CDS sequence (AUadapt) from InfluenzaA__AHL99964__HA

SEQ ID NO: 11984 - RNA, 1701 nt, Artificial Sequence; identical to SEQ ID NO: 10128
  derived and/or modified CDS sequence (AUadapt) from InfluenzaA__AHL99976__HA

SEQ ID NO: 11985 - RNA, 1701 nt, Artificial Sequence; identical to SEQ ID NO: 10128
  derived and/or modified CDS sequence (AUadapt) from InfluenzaA__AHL99988__HA

SEQ ID NO: 11986 - RNA, 1701 nt, Artificial Sequence; identical to SEQ ID NO: 10103
  derived and/or modified CDS sequence (AUadapt) from InfluenzaA__AHM00001__HA

SEQ ID NO: 11987 - RNA, 1701 nt, Artificial Sequence; identical to SEQ ID NO: 10103
  derived and/or modified CDS sequence (AUadapt) from InfluenzaA__AHM00013__HA

SEQ ID NO: 11988 - RNA, 1701 nt, Artificial Sequence; identical to SEQ ID NO: 10113
  derived and/or modified CDS sequence (AUadapt) from InfluenzaA__AHM00025__HA

SEQ ID NO: 11989 - RNA, 1701 nt, Artificial Sequence; identical to SEQ ID NO: 10128
  derived and/or modified CDS sequence (AUadapt) from InfluenzaA__AHM00037__HA

SEQ ID NO: 11990 - RNA, 1701 nt, Artificial Sequence; identical to SEQ ID NO: 10128
  derived and/or modified CDS sequence (AUadapt) from InfluenzaA__AHM00061__HA

SEQ ID NO: 11991 - RNA, 1701 nt, Artificial Sequence; identical to SEQ ID NO: 10103
  derived and/or modified CDS sequence (AUadapt) from InfluenzaA__AHM00073__HA

SEQ ID NO: 11992 - RNA, 1701 nt, Artificial Sequence; identical to SEQ ID NO: 10103
  derived and/or modified CDS sequence (AUadapt) from InfluenzaA__AHM00085__HA

SEQ ID NO: 11993 - RNA, 1701 nt, Artificial Sequence
  derived and/or modified CDS sequence (AUadapt) from InfluenzaA__AHM00097__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaagggguucuacaagaaccugaucuggcucgugaagaagggcaacuccuaccccaagcugagcaacuccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucagcgacaccaccgugcacgacugcaacacgaccugccagacccccaagggggccaucaacaccucccugccguuccagaacauccaccccaucacgaucggcaagugccccaaguacgucaagucgaccaagcugcggcucgccaccgggcugcgcaacgugcccuccauccagucgcggggccuguucggggcgaucgccggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacucgaacgugaagaaccucuacgagaagguccgcaaccagcugaagaacaacgccaaggagaucggcaacgggugcuucgaguucuaccacaagugcgacaacaugugcauggaguccgugaagaacggcaccuacgacuacccgaaguacagcgaggaggccaagcugaaccgggagaagaucgacggggugaagcucgaguccacccgcaucuaccagauccuggccaucuacucgacggucgcguccagccuggugcucguggucucccugggcgccaucucguucuggaugugcagcaacggcucccugcagugccggaucugcaucuga

SEQ ID NO: 11994 - RNA, 1701 nt, Artificial Sequence; identical to SEQ ID NO: 10128
  derived and/or modified CDS sequence (AUadapt) from InfluenzaA__AHM00108__HA

SEQ ID NO: 11995 - RNA, 1701 nt, Artificial Sequence; identical to SEQ ID NO: 10128
  derived and/or modified CDS sequence (AUadapt) from InfluenzaA__AHM00120__HA

SEQ ID NO: 11996 - RNA, 1701 nt, Artificial Sequence
  derived and/or modified CDS sequence (AUadapt) from InfluenzaA__AHM00132__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucucgcuguacgcgcaggccuccgggcggaucaccgugagcacgaagcgcucgcagcaggccgugaucccgaacaucggcucccggccccgcguccggaacauccccucgcgcguguccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgcgugcaucacccccaacggcucgauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagagcacgcaggccgccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggucguacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 11997 - RNA, 1701 nt, Artificial Sequence; identical to SEQ ID NO: 10103
  derived and/or modified CDS sequence (AUadapt) from InfluenzaA__AHM00144__HA

SEQ ID NO: 11998 - RNA, 1701 nt, Artificial Sequence; identical to SEQ ID NO: 10128
  derived and/or modified CDS sequence (AUadapt) from InfluenzaA__AHM00156__HA

SEQ ID NO: 11999 - RNA, 1701 nt, Artificial Sequence; identical to SEQ ID NO: 10103
  derived and/or modified CDS sequence (AUadapt) from InfluenzaA__AHM00168__HA

SEQ ID NO: 12000 - RNA, 1701 nt, Artificial Sequence
  derived and/or modified CDS sequence (AUadapt) from InfluenzaA__AHM00180__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacaacccccaccagauccucgacggcgagaacugcacccugaucgacgcccugcucggggacccccagugcgacggcuuccagaacaagaagugggaccuguucguggagcggucgaaggccuacuccaacugcuaccccuacgacgugccggacuacgcgagccugcgcucccucgucgccucguccggcacccuggaguucaacaacgagagcuucaacuggacgggggugacccagaacggcaccuccucggccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12001 - RNA, 1701 nt, Artificial Sequence; identical to SEQ ID NO: 10080
  derived and/or modified CDS sequence (AUadapt) from InfluenzaA__AHM00192__HA

SEQ ID NO: 12002 - RNA, 1701 nt, Artificial Sequence; identical to SEQ ID NO: 10128
  derived and/or modified CDS sequence (AUadapt) from InfluenzaA__AHM00204__HA

SEQ ID NO: 12003 - RNA, 1701 nt, Artificial Sequence; identical to SEQ ID NO: 10128
  derived and/or modified CDS sequence (AUadapt) from InfluenzaA__AHM00216__HA

SEQ ID NO: 12004 - RNA, 1701 nt, Artificial Sequence; identical to SEQ ID NO: 10103
  derived and/or modified CDS sequence (AUadapt) from InfluenzaA__AHM00228__HA

SEQ ID NO: 12005 - RNA, 1701 nt, Artificial Sequence; identical to SEQ ID NO: 10103
  derived and/or modified CDS sequence (AUadapt) from InfluenzaA__AHM00240__HA

SEQ ID NO: 12006 - RNA, 1701 nt, Artificial Sequence; identical to SEQ ID NO: 10103
  derived and/or modified CDS sequence (AUadapt) from InfluenzaA__AHM00252__HA

SEQ ID NO: 12007 - RNA, 1701 nt, Artificial Sequence; identical to SEQ ID NO: 10103
  derived and/or modified CDS sequence (AUadapt) from InfluenzaA__AHM00264__HA

SEQ ID NO: 12008 - RNA, 1701 nt, Artificial Sequence; identical to SEQ ID NO: 10080
  derived and/or modified CDS sequence (AUadapt) from InfluenzaA__AHM00276__HA

SEQ ID NO: 12009 - RNA, 1701 nt, Artificial Sequence; identical to SEQ ID NO: 10103
  derived and/or modified CDS sequence (AUadapt) from InfluenzaA__AHM00288__HA

SEQ ID NO: 12010 - RNA, 1701 nt, Artificial Sequence; identical to SEQ ID NO: 10103
  derived and/or modified CDS sequence (AUadapt) from InfluenzaA__AHM00300__HA

SEQ ID NO: 12011 - RNA, 1701 nt, Artificial Sequence; identical to SEQ ID NO: 10128
  derived and/or modified CDS sequence (AUadapt) from InfluenzaA__AHM00312__HA

SEQ ID NO: 12012 - RNA, 1701 nt, Artificial Sequence; identical to SEQ ID NO: 10080
  derived and/or modified CDS sequence (AUadapt) from InfluenzaA__AHM00324__HA

SEQ ID NO: 12013 - RNA, 1701 nt, Artificial Sequence; identical to SEQ ID NO: 10080
  derived and/or modified CDS sequence (AUadapt) from InfluenzaA__AHM00336__HA

SEQ ID NO: 12014 - RNA, 1701 nt, Artificial Sequence; identical to SEQ ID NO: 10128
  derived and/or modified CDS sequence (AUadapt) from InfluenzaA__AHM00348__HA

SEQ ID NO: 12015 - RNA, 1701 nt, Artificial Sequence
  derived and/or modified CDS sequence (AUadapt) from InfluenzaA__AHM00360__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacuggacgggggugacccagaacggcaccucguccgccugcauccgccggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 12016 - RNA, 1701 nt, Artificial Sequence; identical to SEQ ID NO: 10128
  derived and/or modified CDS sequence (AUadapt) from InfluenzaA__AHM00372__HA

SEQ ID NO: 12017 - RNA, 1701 nt, Artificial Sequence; identical to SEQ ID NO: 10128
  derived and/or modified CDS sequence (AUadapt) from InfluenzaA__AHM00395__HA

SEQ ID NO: 12018 - RNA, 1701 nt, Artificial Sequence; identical to SEQ ID NO: 10103
  derived and/or modified CDS sequence (AUadapt) from InfluenzaA__AHM00407__HA

SEQ ID NO: 12019 - RNA, 1701 nt, Artificial Sequence; identical to SEQ ID NO: 10103
  derived and/or modified CDS sequence (AUadapt) from InfluenzaA__AHM00419__HA

SEQ ID NO: 12020 - RNA, 1701 nt, Artificial Sequence; identical to SEQ ID NO: 10103
  derived and/or modified CDS sequence (AUadapt) from InfluenzaA__AHM00443__HA

SEQ ID NO: 12021 - RNA, 1701 nt, Artificial Sequence; identical to SEQ ID NO: 10128
  derived and/or modified CDS sequence (AUadapt) from InfluenzaA__AHM00455__HA

SEQ ID NO: 12022 - RNA, 1701 nt, Artificial Sequence; identical to SEQ ID NO: 10128
  derived and/or modified CDS sequence (AUadapt) from InfluenzaA__AHM00467__HA

SEQ ID NO: 12023 - RNA, 1701 nt, Artificial Sequence; identical to SEQ ID NO: 10128
  derived and/or modified CDS sequence (AUadapt) from InfluenzaA__AHM00479__HA

SEQ ID NO: 12024 - RNA, 1701 nt, Artificial Sequence; identical to SEQ ID NO: 10128
  derived and/or modified CDS sequence (AUadapt) from InfluenzaA__AHM00491__HA

SEQ ID NO: 12025 - RNA, 1701 nt, Artificial Sequence; identical to SEQ ID NO: 10103
  derived and/or modified CDS sequence (AUadapt) from InfluenzaA__AHM00503__HA

SEQ ID NO: 12026 - RNA, 1701 nt, Artificial Sequence; identical to SEQ ID NO: 10103
  derived and/or modified CDS sequence (AUadapt) from InfluenzaA__AHM00515__HA

SEQ ID NO: 12027 - RNA, 1701 nt, Artificial Sequence
  derived and/or modified CDS sequence (AUadapt) from InfluenzaA__AHM00527__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagccccaucggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuacccguacgacgugcccgacuacgcgucgcugcgcucccucgucgccagcuccggcacccuggaguucaacaacgagucguucaacuggacgggggugacccagaacggcaccuccagcgccugcauccggcgcuccaacucguccuucuucagccggcugaacuggcucacccaccugaacuucaaguaccccgcccugaacgugacgaugcccaacaacgagcaguucgacaagcucuacaucuggggcguccaccacccggggaccgacaaggaccagaucuuccuguacgcgcaguccucggggcgcaucaccguguccaccaagcggagccagcaggccgugauccccaacaucggcucgcgcccccggauccgcaacauccccucccggaucagcaucuacuggacgaucgucaagccgggcgacauccugcucaucaacuccaccgggaaccugaucgcgccccgcggcuacuucaagauccggucggggaaguccagcaucaugcgcuccgacgcccccaucggcaagugcaagucggagugcaucacccccaacggcuccaucccgaacgacaagcccuuccagaacgugaaccggaucaccuacggggccugcccccgcuacgugaagcagagcacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccugaaguccacccaggcggccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12028 - RNA, 1701 nt, Artificial Sequence; identical to SEQ ID NO: 10080
  derived and/or modified CDS sequence (AUadapt) from InfluenzaA__AHM00539__HA

SEQ ID NO: 12029 - RNA, 1701 nt, Artificial Sequence
  derived and/or modified CDS sequence (AUadapt) from InfluenzaA__AHM00543__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgucgcugcggucccucgucgccagcuccggcacgauggaguucaacaacgagucguucaacuggaccggggugacccagaacggcaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccucggggcggaucaccguguccacgaagcgcagccagcaggccgugaucccgaacaucggcucgcggccccgcguccggaacauccccucccgcgugucgaucuacuggaccaucgugaagcccggcgacauccugcugaucaacuccaccgggaaccucaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccucaaguccacgcaggccgccaucgaccagaucaacgggaagcugaaccgccugaucggcaagaccaacgagaaguuccaccagaucgagaaggaguucucggagguggagggccggauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagucgggcuacaaggacuggauccuguggaucuccuucgccaucagcugcuuccugcucugcgucgcgcugcugggcuucaucaugugggccugccagaaggggaacauccggugcaacaucugcaucuga

SEQ ID NO: 12030 - RNA, 1701 nt, Artificial Sequence; identical to SEQ ID NO: 10103
  derived and/or modified CDS sequence (AUadapt) from InfluenzaA__AHM00555__HA

SEQ ID NO: 12031 - RNA, 1701 nt, Artificial Sequence
  derived and/or modified CDS sequence (AUadapt) from InfluenzaA__AHM00567__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccgcaagagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugagcaccaagcgcucgcagcaggccgugaucccgaacaucggcucccggccccgcauccggaacauccccagccgcaucuccaucuacuggacgaucgucaagcccggcgacauccugcucaucaacucgaccgggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 12032 - RNA, 1701 nt, Artificial Sequence; identical to SEQ ID NO: 10103
  derived and/or modified CDS sequence (AUadapt) from InfluenzaA__AHM00579__HA

SEQ ID NO: 12033 - RNA, 1701 nt, Artificial Sequence; identical to SEQ ID NO: 10128
  derived and/or modified CDS sequence (AUadapt) from InfluenzaA__AHM00591__HA

SEQ ID NO: 12034 - RNA, 1701 nt, Artificial Sequence; identical to SEQ ID NO: 10103
  derived and/or modified CDS sequence (AUadapt) from InfluenzaA__AHM00603__HA

SEQ ID NO: 12035 - RNA, 1701 nt, Artificial Sequence; identical to SEQ ID NO: 10103
  derived and/or modified CDS sequence (AUadapt) from InfluenzaA__AHM00615__HA

SEQ ID NO: 12036 - RNA, 1701 nt, Artificial Sequence
  derived and/or modified CDS sequence (AUadapt) from InfluenzaA__AHM00627__HA
augaagaccaccaucgcccugucguacauccucugccugguguucgcccagaagcugcccggcaacgacaacuccacggcgacccucugccuggggcaccacgccgucccgaacggcaccaucgugaagaccaucacgaacgaccgcaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacgcuggaguucaacaacgaguccuucaacuggaccggggugacccagaacggcaccucguccgccugcauccggcgcagcaacuccucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagagcuccgggcgcaucaccgugucgacgaagcggagccagcaggccgugaucccgaacaucggcucccgcccccggauccgcaacauccccucgcggaucuccaucuacuggaccaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucacguacggggccugcccccgcuacgugaagcaguccacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12037 - RNA, 1701 nt, Artificial Sequence; identical to SEQ ID NO: 10103
  derived and/or modified CDS sequence (AUadapt) from InfluenzaA__AHM00639__HA

SEQ ID NO: 12038 - RNA, 1701 nt, Artificial Sequence; identical to SEQ ID NO: 10080
  derived and/or modified CDS sequence (AUadapt) from InfluenzaA__AHM00651__HA

SEQ ID NO: 12039 - RNA, 1701 nt, Artificial Sequence; identical to SEQ ID NO: 162
  derived and/or modified CDS sequence (AUadapt) from InfluenzaA__AHM00663__HA

SEQ ID NO: 12040 - RNA, 1701 nt, Artificial Sequence; identical to SEQ ID NO: 10128
  derived and/or modified CDS sequence (AUadapt) from InfluenzaA__AHM00675__HA

SEQ ID NO: 12041 - RNA, 1701 nt, Artificial Sequence; identical to SEQ ID NO: 11190
  derived and/or modified CDS sequence (AUadapt) from InfluenzaA__AHM00687__HA

SEQ ID NO: 12042 - RNA, 1701 nt, Artificial Sequence
  derived and/or modified CDS sequence (AUadapt) from InfluenzaA__AHM00698__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcacgcgccgguccaacaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucacgguguccaccaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacucggcgugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggcggggccaggcggccgaccugaaguccacccaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgccgagcuccuggucgcgcuggagaaccagcacacgaucgaccucaccgacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 12043 - RNA, 1701 nt, Artificial Sequence; identical to SEQ ID NO: 10103
  derived and/or modified CDS sequence (AUadapt) from InfluenzaA__AHM00710__HA

SEQ ID NO: 12044 - RNA, 1701 nt, Artificial Sequence; identical to SEQ ID NO: 10103
  derived and/or modified CDS sequence (AUadapt) from InfluenzaA__AHM00722__HA

SEQ ID NO: 12045 - RNA, 1701 nt, Artificial Sequence; identical to SEQ ID NO: 10103
  derived and/or modified CDS sequence (AUadapt) from InfluenzaA__AHM00734__HA

SEQ ID NO: 12046 - RNA, 1701 nt, Artificial Sequence; identical to SEQ ID NO: 10238
  derived and/or modified CDS sequence (AUadapt) from InfluenzaA__AHM00746__HA

SEQ ID NO: 12047 - RNA, 1701 nt, Artificial Sequence; identical to SEQ ID NO: 10103
  derived and/or modified CDS sequence (AUadapt) from InfluenzaA__AHM00758__HA

SEQ ID NO: 12048 - RNA, 1701 nt, Artificial Sequence; identical to SEQ ID NO: 10271
  derived and/or modified CDS sequence (AUadapt) from InfluenzaA__AHM00770__HA

SEQ ID NO: 12049 - RNA, 1701 nt, Artificial Sequence; identical to SEQ ID NO: 10080
  derived and/or modified CDS sequence (AUadapt) from InfluenzaA__AHM00782__HA

SEQ ID NO: 12050 - RNA, 1701 nt, Artificial Sequence
  derived and/or modified CDS sequence (AUadapt) from InfluenzaA__AHM00794__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcucgcucgucgcguccagcggcacgcuggaguucaacaacgaguccuucaacuggaccggggugacccagaacggcaccucguccgccugcauccggcgcagcaacuccucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccagagcuccgggcgcaucaccgugagcacgaagcggucgcagcaggcggugaucccgaacaucggcucccgcccccggauccgcaacauccccagccggaucuccaucuacuggaccaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcaguccacccugaagcucgccaccggcaugcggaacguccccgagaagcagacccgcgggaucuucggcgcgaucgccggguucaucgagaacggcugggagggcaugguggacgggugguacggcuuccggcaccagaacucggaggggcgcggccaggccgccgaccugaaguccacgcaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcgcucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12051 - RNA, 1701 nt, Artificial Sequence; identical to SEQ ID NO: 10271
  derived and/or modified CDS sequence (AUadapt) from InfluenzaA__AHM00806__HA

SEQ ID NO: 12052 - RNA, 1701 nt, Artificial Sequence
  derived and/or modified CDS sequence (AUadapt) from InfluenzaA__AHM00818__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgagaacuucaacuggacgggggugacccagaacggcaccuccucggccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12053 - RNA, 1701 nt, Artificial Sequence; identical to SEQ ID NO: 10128
  derived and/or modified CDS sequence (AUadapt) from InfluenzaA__AHM00830__HA

SEQ ID NO: 12054 - RNA, 1701 nt, Artificial Sequence; identical to SEQ ID NO: 10128
  derived and/or modified CDS sequence (AUadapt) from InfluenzaA__AHM00842__HA

SEQ ID NO: 12055 - RNA, 1701 nt, Artificial Sequence; identical to SEQ ID NO: 12031
  derived and/or modified CDS sequence (AUadapt) from InfluenzaA__AHM00854__HA

SEQ ID NO: 12056 - RNA, 1701 nt, Artificial Sequence; identical to SEQ ID NO: 12031
  derived and/or modified CDS sequence (AUadapt) from InfluenzaA__AHM00866__HA

SEQ ID NO: 12057 - RNA, 1701 nt, Artificial Sequence; identical to SEQ ID NO: 10103
  derived and/or modified CDS sequence (AUadapt) from InfluenzaA__AHM00878__HA

SEQ ID NO: 12058 - RNA, 1701 nt, Artificial Sequence; identical to SEQ ID NO: 10080
  derived and/or modified CDS sequence (AUadapt) from InfluenzaA__AHM00890__HA

SEQ ID NO: 12059 - RNA, 1701 nt, Artificial Sequence; identical to SEQ ID NO: 10113
  derived and/or modified CDS sequence (AUadapt) from InfluenzaA__AHM00902__HA

SEQ ID NO: 12060 - RNA, 1701 nt, Artificial Sequence; identical to SEQ ID NO: 10103
  derived and/or modified CDS sequence (AUadapt) from InfluenzaA__AHM00914__HA

SEQ ID NO: 12061 - RNA, 1701 nt, Artificial Sequence; identical to SEQ ID NO: 10103
  derived and/or modified CDS sequence (AUadapt) from InfluenzaA__AHM00926__HA

SEQ ID NO: 12062 - RNA, 1701 nt, Artificial Sequence; identical to SEQ ID NO: 10080
  derived and/or modified CDS sequence (AUadapt) from InfluenzaA__AHM00938__HA

SEQ ID NO: 12063 - RNA, 1701 nt, Artificial Sequence
  derived and/or modified CDS sequence (AUadapt) from InfluenzaA__AHM00950__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgucucccugcgcucgcucguggcguccagcggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcccagucguccgggcgcaucaccgugagcaccaagcggagccagcaggcggucaucccgaacaucggcucccgcccccggauccgcaacauccccucgcggaucuccaucuacuggacgaucgugaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgucaagcaguccacgcugaagcucgccaccggcaugcggaacgugcccgagaagcagacccgcgggaucuucggcgcgaucgccggguucaucgagaacggcugggagggcaugguggacgggugguacggcuuccggcaccagaacucggaggggcgcggccaggccgccgaccugaaguccacccaggccgcgaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgccugcaucggguccauccggaacggcaccuacgaccacaacgucuaccgcgacgaggcgcucaacaaccgguuccagaucaaggggguggagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 12064 - RNA, 1701 nt, Artificial Sequence; identical to SEQ ID NO: 10080
  derived and/or modified CDS sequence (AUadapt) from InfluenzaA__AHM00962__HA

SEQ ID NO: 12065 - RNA, 1701 nt, Artificial Sequence
  derived and/or modified CDS sequence (AUadapt) from InfluenzaA__AHM00974__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggggcaucaccguguccacgaagcggucgcagcaggccgugaucccgaacaucggcucgcgcccccggguccgcaacauccccucccgggugagcaucuacuggaccaucgugaagcccggggacauccugcucaucaacuccaccggcaaccugaucgccccgcgcggguacuucaagauccggucgggcaaguccagcaucaugcgcuccgacgcccccaucggcaagugcaacucggcgugcaucacccccaacggguccauccccaacgacaagccguuccagaacgucaaccggaucacguacggcgccugcccccgcuacgugaagcagaacacccugaagcucgccaccgggaugcggaacgugcccgagaagcagacccgcggcaucuucggggccaucgccggcuucaucgagaacggcugggaggggauggucgacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacaugggcaacgggugcuucaagaucuaccacaagugcgacaacgccugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcgcugcucggguucaucaugugggccugccagaagggcaacauccgcugcaacaucugcaucuga

SEQ ID NO: 12066 - RNA, 1683 nt, Artificial Sequence
  derived and/or modified CDS sequence (AUadapt) from InfluenzaA__AHM24224__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguuuagcgccgaccugaucaucgagcgccgggaaggguccgacgugugcuaccccggcaaguucgugaaggaggaggcccugcgccagauccuccgggagagcgggggcaucgacaaggaggcgaugggguucaccuauuccggcauccgcaccaacggcgccaccagcgccugccggcgcuccgggagcuccuucuacgccgagaugaaguggcugcugagcaacacggauaacgcggccuucccgcagaugaccaaguccuacaagaacacccgcaagagccccgcccucaucgucuggggcauccaccacuccgugagcaccgccgaacagacgaagcuguacggguccggcaauaagcuggugaccgucggcagcuccaacuaccagcagagcuucgugcccucccccggggcccggccccaggugaacggccucagcgggcggaucgacuuucacuggcugaugcugaaccccaacgacaccgucaccuucagcuucaacggcgcguucaucgcccccgaucgcgccuccuuccuccggggcaagagcauggggauccaguccggcguccagguggacgccaacugcgagggggacugcuaccauagcggcgggacgaucaucuccaaccugcccuuccagaacaucgacagccgcgccgugggcaagugcccgcgguacgugaagcagcgcucccugcuccuggcgaccgggaugaaaaaugugcccgagauccccaagggccggggccuguucggggccaucgccggcuucaucgagaacgggugggagggccucaucgacgggugguacggcuuccgccaccagaacgcccagggcgaggggaccgccgcggacuauaagagcacccaguccgccaucgaccagaucacgggcaagcugaaccggcugaucgagaagaccaaccagcaauucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaagcuguacgagcgcgugaagcggcaacugcgcgagaacgcggaggaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 12067 - RNA, 1683 nt, Artificial Sequence; identical to SEQ ID NO: 86
  derived and/or modified CDS sequence (AUadapt) from InfluenzaA__AHM24236__HA

SEQ ID NO: 12068 - RNA, 1683 nt, Artificial Sequence; identical to SEQ ID NO: 86
  derived and/or modified CDS sequence (AUadapt) from InfluenzaA__AHM24248__HA

SEQ ID NO: 12069 - RNA, 1701 nt, Artificial Sequence
  derived and/or modified CDS sequence (AUadapt) from InfluenzaA__AHM98309__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgaggucuuccccaagaccagcuccuggcccaaccacgacucgaacaagggggugaccgccgccugcccgcacgccggcgcgaaguccuucuacaagaaccugaucuggcucgugaagaaggggaacagcuaccccaagcuguccaagucguacaucaacgacaagggcaaggagguccuggugcucugggggauccaccaccccagcaccacggccgaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgucaaguccaccaagcugcggcucgcgacgggccugcgcaacgugccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 12070 - RNA, 1710 nt, Artificial Sequence
  derived and/or modified CDS sequence (AUadapt) from InfluenzaA__AHM98339__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccucgcugaccucccugcccuuccagaacauccaccccaucaccaucgggaagugccccaaguacgucaagagcacgaagcuccggcuggcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucacgaacaaggugaacuccgucaucgagaagaugaacacccaguucaccgccgugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacucgaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacucgaccgucgccuccagccucgugcugguggucucgcugggggccaucuccuucuggaugugcagcaacggcucccuccagugccggaucugcaucuga

SEQ ID NO: 12071 - RNA, 1701 nt, Artificial Sequence
  derived and/or modified CDS sequence (AUadapt) from InfluenzaA__AHM98350__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccucguccuggcccaaccacgacgccaacaagggggucaccgccgccugcccgcacgcgggcgccaagggguucuacaagaaccugaucuggcuggugaagaagggcaacagcuaccccaagcucuccaagucguacaucaacgacaaggggaaggaggugcugguccuguggggcauccaccaccccuccaccacggccgaccagcagucgcucuaccagaacgccgacaccuacguguucgugggcaccagccgguacuccaagaaguucaagcccgagaucgccauccgcccgaagguccgggaccaggaggggcgcaugaacuacuacuggacccugguggagcccggcgacaagaucacguucgaggcgaccgggaaccugguggucccccgguacgccuucgccauggagcgcaacgccggcucgggcaucaucaucuccgacacccccgugcacgacugcaacaccacgugccagaccccgaagggggccaucaacaccucgcuccccuuccagaacauccaccccaucaccaucggcaagugccccaaguacgugaaguccacgaagcugcggcuggcgaccgggcuccgcaacgucccgagcauccagucccggggccuguucggggccaucgccggcuucaucgagggcggguggaccggcaugguggacgggugguacggcuaccaccaccagaacgagcaggggucgggcuacgccgccgaccugaaguccacccagaacgcgaucgacaagaucacgaacaaggugaacucggucaucgagaagaugaacacccaguucaccgccgugggcaaggaguucaaccaccucgagaagcgcaucgagaaccugaacaagaaggucgacgacggguuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcuggagucgacccgcaucuaccagauccucgcgaucuacuccaccgucgccucgucccuggugcugguggucagccucggcgccaucuccuucuggaugugcucgaacggcagccugcagugccggaucugcaucuga

SEQ ID NO: 12072 - RNA, 1701 nt, Artificial Sequence; identical to SEQ ID NO: 6699
  derived and/or modified CDS sequence (AUadapt) from InfluenzaA__AHM98361__HA

SEQ ID NO: 12073 - RNA, 1701 nt, Artificial Sequence; identical to SEQ ID NO: 7112
  derived and/or modified CDS sequence (AUadapt) from InfluenzaA__AHM98372__HA

SEQ ID NO: 12074 - RNA, 1701 nt, Artificial Sequence; identical to SEQ ID NO: 7112
  derived and/or modified CDS sequence (AUadapt) from InfluenzaA__AHM98383__HA

SEQ ID NO: 12075 - RNA, 1701 nt, Artificial Sequence; identical to SEQ ID NO: 7069
  derived and/or modified CDS sequence (AUadapt) from InfluenzaA__AHM98394__HA

SEQ ID NO: 12076 - RNA, 1701 nt, Artificial Sequence
  derived and/or modified CDS sequence (AUadapt) from InfluenzaA__AHM98405__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucaagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 12077 - RNA, 1701 nt, Artificial Sequence; identical to SEQ ID NO: 12076
  derived and/or modified CDS sequence (AUadapt) from InfluenzaA__AHM98416__HA

SEQ ID NO: 12078 - RNA, 1701 nt, Artificial Sequence; identical to SEQ ID NO: 7069
  derived and/or modified CDS sequence (AUadapt) from InfluenzaA__AHM98427__HA

SEQ ID NO: 12079 - RNA, 1701 nt, Artificial Sequence; identical to SEQ ID NO: 7287
  derived and/or modified CDS sequence (AUadapt) from InfluenzaA__AHM98438__HA

SEQ ID NO: 12080 - RNA, 1701 nt, Artificial Sequence; identical to SEQ ID NO: 8431
  derived and/or modified CDS sequence (AUadapt) from InfluenzaA__AHM98449__HA

SEQ ID NO: 12081 - RNA, 1701 nt, Artificial Sequence
  derived and/or modified CDS sequence (AUadapt) from InfluenzaA__AHM98460__HA
augaaggccauccuggugguccuccugugcaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacaccaccgugcacgacugcaacacgaccugccagacccccaagggggccaucaacaccucccugccguuccagaacauccaccccaucacgaucggcaagugccccaaguacgucaagucgaccaagcugcggcucgccaccgggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagucgacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuacccgaaguacucggaggaggccaagcugaaccgggagaagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 12082 - RNA, 1701 nt, Artificial Sequence; identical to SEQ ID NO: 7112
  derived and/or modified CDS sequence (AUadapt) from InfluenzaA__AHM98471__HA

SEQ ID NO: 12083 - RNA, 1701 nt, Artificial Sequence
  derived and/or modified CDS sequence (AUadapt) from InfluenzaA__AHM98482__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgacaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 12084 - RNA, 1701 nt, Artificial Sequence
  derived and/or modified CDS sequence (AUadapt) from InfluenzaA__AHM98493__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaaguaccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgcgaggagaucgacggcgugaagcuggagagcacccggaucuaccagauccuggcgaucuacuccaccgucgccucgagccucgugcugguggucucccugggggccaucucguucuggaugugcuccaacggcagccuccagugccgcaucugcaucuga

SEQ ID NO: 12085 - RNA, 1701 nt, Artificial Sequence
  derived and/or modified CDS sequence (AUadapt) from InfluenzaA__AHM98504__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccaaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12086 - RNA, 1701 nt, Artificial Sequence; identical to SEQ ID NO: 6699
  derived and/or modified CDS sequence (AUadapt) from InfluenzaA__AHM98515__HA

SEQ ID NO: 12087 - RNA, 1701 nt, Artificial Sequence
  derived and/or modified CDS sequence (AUadapt) from InfluenzaA__AHM98526__HA
augaaggccauccuggugguccuccugcacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagagcacgaagcugcggcucgccaccgggcugcgcaacgugccguccauccagucgcggggccuguucggggcgaucgccggcuucaucgagggcggguggaccggcaugguggacgggugguacggcuaccaccaccagaacgagcagggguccggcuacgccgccgaccuccgcucgacccagaacgccaucgacaagaucacgaacaaggugaacuccgucaucgagaagaugaacacccaguucaccgcggugggcaaggaguucaaccaccuggagaagcggaucgagaaccugaacaagaaggucgacgacggguuccucgacaucuggaccuacaacgccgagcugcugauccuccuggagaacgagcgcacgcuggacuaccacgacagcaacgugaagaaccucuacgagaaggugcggaaccagcugaagaacaacgccaaggagaucggcaacgggugcuucgaguucuaccacaagugcgacaacacgugcauggaguccgucaagaacggcaccuacgacuaccccaaguacucggaggaggccaagcugaaccgcgaggagaucgacggggugaagcucgaguccacccggaucuaccagauccuggccaucuacucgaccguggcguccagccugguccucguggugucccugggcgccaucucguucuggaugugcagcaacggcucccugcagugccgcaucugcaucuga

SEQ ID NO: 12088 - RNA, 1701 nt, Artificial Sequence; identical to SEQ ID NO: 6699
  derived and/or modified CDS sequence (AUadapt) from InfluenzaA__AHM98537__HA

SEQ ID NO: 12089 - RNA, 1701 nt, Artificial Sequence
  derived and/or modified CDS sequence (AUadapt) from InfluenzaA__AHM98548__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccgugaccaucgggaagugccccaaguacgucaaguccaccaagcugcggcucgcgacgggccugcgcaacgugccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 12090 - RNA, 1701 nt, Artificial Sequence
  derived and/or modified CDS sequence (AUadapt) from InfluenzaA__AHM98559__HA
augaaggccauccuggugguccuccuguacaccuucgccaccgcgaaggccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12091 - RNA, 1701 nt, Artificial Sequence; identical to SEQ ID NO: 7069
  derived and/or modified CDS sequence (AUadapt) from InfluenzaA__AHM98570__HA

SEQ ID NO: 12092 - RNA, 1701 nt, Artificial Sequence
  derived and/or modified CDS sequence (AUadapt) from InfluenzaA__AHM98581__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcccggagcugguccuacaucguggagaccucguccucggacaacggcacgugcuaccccggcgacuucaucgacuacgaggagcuccgcgagcagcuguccagcguguccucguucaagcgguucgagaucuuccccaagaccuccucguggcccaaccacgacuccaacaagggggucaccgccgccugcccgcacgccggcgcgaagggguucuacaagaaccugaucuggcucgugaagaagggcaacagcuaccccaagcuguccaagucguacaucaacgacaaggggaaggaggugcugguccucuggggcauccaccaccccuccaccacggccgaccagcagucgcuguaccagaacgccgacaccuacguguucgugggcaccagccgcuacuccaagaaguucaagcccgagaucgccauccggccgaagguccgcgaccaggaggggcggaugaacuacuacuggacccugguggagcccggcgacaagaucacguucgaggccaccgggaaccucguggucccccgcuacgcguucgccauggagcggaacgccggcucgggcaucaucaucuccgacacccccgugcacgacugcaacaccacgugccagaccccgaagggggccaucaacaccucgcugcccuuccagaacauccaccccaucaccaucggcaagugccccaaguacgugaaguccacgaagcugcgccucgccaccgggcugcggaacgucccgagcauccagucccgcggccuguucggggcgaucgccggcuucaucgagggcggguggaccggcaugguggacgggugguacggcuaccaccaccagaacgagcaggggucgggcuacgccgccgaccucaaguccacccagaacgccaucgacaagaucacgaacaaggugaacucggucaucgagaagaugaacacccaguucaccgcggugggcaaggaguucaaccaccuggagaagcggaucgagaaccugaacaagaaggucgacgacggguuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagucgacccggaucuaccagauccuggccaucuacuccaccgucgcgucgucccuggugcucguggucagccugggcgccaucuccuucuggaugugcucgaacggcagccugcagugccgcaucugcaucuga

SEQ ID NO: 12093 - RNA, 1701 nt, Artificial Sequence; identical to SEQ ID NO: 7069
  derived and/or modified CDS sequence (AUadapt) from InfluenzaA__AHM98592__HA

SEQ ID NO: 12094 - RNA, 1701 nt, Artificial Sequence; identical to SEQ ID NO: 7112
  derived and/or modified CDS sequence (AUadapt) from InfluenzaA__AHM98603__HA

SEQ ID NO: 12095 - RNA, 1701 nt, Artificial Sequence; identical to SEQ ID NO: 6699
  derived and/or modified CDS sequence (AUadapt) from InfluenzaA__AHM98614__HA

SEQ ID NO: 12096 - RNA, 1701 nt, Artificial Sequence; identical to SEQ ID NO: 12076
  derived and/or modified CDS sequence (AUadapt) from InfluenzaA__AHM98625__HA

SEQ ID NO: 12097 - RNA, 1701 nt, Artificial Sequence; identical to SEQ ID NO: 12076
  derived and/or modified CDS sequence (AUadapt) from InfluenzaA__AHM98636__HA

SEQ ID NO: 12098 - RNA, 1701 nt, Artificial Sequence
  derived and/or modified CDS sequence (AUadapt) from InfluenzaA__AHM98647__HA
augaaggccauccuggugguccuccuguacaccuucgccaccgcgaaggccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12099 - RNA, 1701 nt, Artificial Sequence; identical to SEQ ID NO: 7112
  derived and/or modified CDS sequence (AUadapt) from InfluenzaA__AHM98658__HA

SEQ ID NO: 12100 - RNA, 1701 nt, Artificial Sequence; identical to SEQ ID NO: 7069
  derived and/or modified CDS sequence (AUadapt) from InfluenzaA__AHM98669__HA

SEQ ID NO: 12101 - RNA, 1701 nt, Artificial Sequence; identical to SEQ ID NO: 8431
  derived and/or modified CDS sequence (AUadapt) from InfluenzaA__AHM98701__HA

SEQ ID NO: 12102 - RNA, 1701 nt, Artificial Sequence; identical to SEQ ID NO: 8431
  derived and/or modified CDS sequence (AUadapt) from InfluenzaA__AHM98712__HA

SEQ ID NO: 12103 - RNA, 1701 nt, Artificial Sequence
  derived and/or modified CDS sequence (AUadapt) from InfluenzaA__AHM98723__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaacugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagauccugcccaagaccucguccuggcccaaccacgacucgaacaagggggucaccgccgccugcccgcaggccggcgcgaaguccuucuacaagaaccucaucuggcuggugaagaaggggaacagcuaccccaagcuguccaagucguacaucaacgacaagggcaaggaggugcucguccugugggggauccaccaccccagcaccuccgccgaccagcagucgcuguaccagaacgccgacgccuacguguucgugggcacguccaaguacagcaagaaguucaagcccgagaucgccguccggccgaaggugcgcgaccaggagggccggaugaacuacuacuggacccucaucgagcccggggacaagaucaccuucgaggcgaccggcaaccugcuggugccccgcuacgccuucgccauggagcggaacgccggguccggcaucaucaucucggacacgcccguccacgacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagucgcgcgggcuguucggcgccaucgccggguucaucgagggcggcuggacggggaugguggacggcugguacggguaccaccaccagaacgcccagggcuccggguacgccgcggaccucaagucgacccagaacgccaucgacaagaucaccaacaaggugaacuccgugaucgagaagaugaacacccaguucacggccgucggcaaggaguucaaccaccuggagaagcggaucgagaaccugaacaagaagguggacgacggcuuccuggacaucuggaccuacaacgccgagcuccugguccugcucgagaacgagcgcacccuggacuaccacgacagcaacgugaagaaccuguacgagaaggugcggucccagcucaagaacaacgccaaggagaucgggaacggcugcuucgaguucuaccacaagugcgacaacacgugcauggagucggucaagaacgggaccuacgacuacccccgcuacuccgaggaggcgaagcugaaccgggaggagaucgacggcgugaagcuggagagcacccgcaucuaccagauccucgccaucuacuccaccguggccucgagccugguccugaucgugucccucggggccaucucguucuggaugugcuccaacggcagccugcagugccggaucugcaucuga

SEQ ID NO: 12104 - RNA, 1701 nt, Artificial Sequence
  derived and/or modified CDS sequence (AUadapt) from InfluenzaA__AHM98734__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcaacuccgacaacgggaccugcuaccccggcgacuucaucgacuacgaggagcuccgggagcagcugucguccgugucguccuucgagcgcuucgagaucuuccccaagaccagcuccuggcccaaccacgacucgaacaagggcgucaccgccgccugcccgcacgccggcuccaagggguucuacaagaaccugaucuggcucgugaagaagggcaacucguaccccaagcuguccaagagcuacaucaacgacaaggggaaggaggugcugguccucuggggcauccaccaccccuccacgaccgcggaccagcagucgcuguaccagaacgccgacaccuacguguucgugggcaccucgcgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgccuucgcgauggagcgcgacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgucgauccagucccggggccuguucggggccaucgcgggcuucaucgagggcggguggaccggcaugguggacgggugguacggcuaccaccaccagaacgagcaggggucgggcuacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgcggagcugcuggugcuccuggagaacgagcggacccuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggccaucuacuccaccgccgcgagcucccugguccucguggugucgcugggcgccaucuccuucuggaugugcucgaacggcagccugcagugccggaucugcaucuga

SEQ ID NO: 12105 - RNA, 1701 nt, Artificial Sequence; identical to SEQ ID NO: 8431
  derived and/or modified CDS sequence (AUadapt) from InfluenzaA__AHM98745__HA

SEQ ID NO: 12106 - RNA, 1701 nt, Artificial Sequence
  derived and/or modified CDS sequence (AUadapt) from InfluenzaA__AHM98756__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccagcugguccuacaucguggagacgucguccucggacaacgggaccugcuaccccggcgacuucaucgacuacgaggagcuccgggagcagcuguccagcguguccucguucgagcgcuucgagaucuuccccaagaccuccucguggcccaaccacgacuccaacaagggcgucaccgccgccugcccgcacgccggcgcgaagggguucuacaagaaccugaucuggcucgugaagaagggcaacagcuaccccaagcuguccaagucguacaucaacgacaaggggaaggaggugcugguccucuggggcauccaccaccccuccacgaccgccgaccagcagucgcuguaccagaacgccgacaccuacguguucgugggcaccagccgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcucgggcaucaucaucuccgacacccccgugcacgacugcaacacgaccugccagaccccgaagggggccaucaacaccucgcugcccuuccagaacauccaccccaucacgaucggcaagugccccaaguacgugaaguccaccaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggucgggcuacgccgccgaccucaaguccacgcagaacgccaucgacaagaucaccaacaaggugaacucggucaucgugaagaugaacacccaguucaccgcggucggcaaggaguucaaccaccuggagaagcgcaucgagaaccugaacaagaagguggacgacggguuccucgacaucuggacguacaacgccgagcugcuggugcuccuggagaacgagcggacccuggacuaccacgacuccaacgucaagaaccucuacgagaaggugcgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggucaagcucgagucgacccgcaucuaccagauccuggccaucuacuccaccgcggccucgucccuggugcucguggucagccugggcgccaucuccuucuggaugugcucgaacggcagccugcagugccggaucugcaucuga

SEQ ID NO: 12107 - RNA, 1701 nt, Artificial Sequence; identical to SEQ ID NO: 8431
  derived and/or modified CDS sequence (AUadapt) from InfluenzaA__AHM98767__HA

SEQ ID NO: 12108 - RNA, 1701 nt, Artificial Sequence
  derived and/or modified CDS sequence (AUadapt) from InfluenzaA__AHM98778__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggacgugcuaccccggcgacuucaucaacuacgaggagcuccgggagcagcugucguccgugucguccuucgagcgguucgagaucuuccccaagaccagcuccuggcccaaccacgacucgaacaagggcgucaccgccgccugcccgcgcgccggggcgaaguccuucuacaagaaccugaucuggcucgugaagaagggcaacagcuaccccaagcuguccaagucguacaucaacgacaaggggaaggaggugcugguccucuggggcauccaccaccccagcaccacggccgaccagcagucccuguaccagaacgccgacgccuacguguucguggggaccucgcgguacuccaagaaguucaagcccgagaucgccauccgcccgaagguccgggaccaggagggccgcaugaacuacuacuggacccugguggagcccggcgacaagaucaccuucgaggcgacggggaaccuccuggugccccgguacgccuucgccauggagcgcaacgccggcucggggaucaucaucuccgacacccccguccacgacugcaacacgaccugccagaccccgaagggcgccaucaacaccagccugcccuuccagaacauccaccccaucaccaucggcaagugccccaaguacgugaaguccaccaagcuccggcuggcgacggggcugcgcaacgugccgucgauccagucccggggccucuucggggccaucgccggcuucaucgagggcggguggaccggcauggucgacgggugguacggcuaccaccaccagaacgagcaggggagcggcuacgccgccgaccugaaguccacccagaacgcgaucgacaagaucaccaacaaggugaacucggugaucgagaagaugaacacgcaguucaccgccgucgggaaggaguucaaccaccuggagaagcgcaucgagaaccucaacaagaagguggacgacggcuuccuggacaucuggaccuacaacgccgagcugcucguccugcuggagaacgagcggacccucgacuaccacgacuccaacgugaagaaccuguacgagaaggugcgcaaccagcugaagaacaacgccaaggagaucggcaacgggugcuucgaguucuaccacaagugcgacaacacgugcauggagucggucaagaacggcaccuacgacuaccccaaguacuccgaggaggccaagcucaaccgggaggagaucgacggggugaagcuggagagcacccgcaucuaccagauccuggcgaucuacuccaccguggccucgucccucguccugguggugagccugggcgccaucucguucuggaugugcuccaacgggagccuccagugccggaucugcaucuga

SEQ ID NO: 12109 - RNA, 1701 nt, Artificial Sequence; identical to SEQ ID NO: 7295
  derived and/or modified CDS sequence (AUadapt) from InfluenzaA__AHM98798__HA

SEQ ID NO: 12110 - RNA, 1701 nt, Artificial Sequence; identical to SEQ ID NO: 7069
  derived and/or modified CDS sequence (AUadapt) from InfluenzaA__AHM98809__HA

SEQ ID NO: 12111 - RNA, 1701 nt, Artificial Sequence; identical to SEQ ID NO: 7069
  derived and/or modified CDS sequence (AUadapt) from InfluenzaA__AHM98820__HA

SEQ ID NO: 12112 - RNA, 1701 nt, Artificial Sequence; identical to SEQ ID NO: 7069
  derived and/or modified CDS sequence (AUadapt) from InfluenzaA__AHM98831__HA

SEQ ID NO: 12113 - RNA, 1701 nt, Artificial Sequence
  derived and/or modified CDS sequence (AUadapt) from InfluenzaA__AHM98836__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacucgaacaagggggucaccgccgccugcccgcacgccggcgcgaagggguucuacaagaaccugaucuggcuggugaagaagggcaacuccuaccccaagcucagcaaguccuacaucaacgacaaggggaaggaggugcugguccuguggggcauccaccaccccucgaccacggccgaccagcagagccucuaccagaacgccgacaccuacguguucgugggcaccucccgguacucgaagaaguucaagcccgagaucgccauccgcccgaagguccgggaccaggaggggcgcaugaacuacuacuggauccugguggagcccggcgacaagaucaccuucgaggccacggggaaccugguggucccccgguacgcguucgccauggagcgcaacgccggcuccggcaucaucaucagcgacacccccgugcacgacugcaacacgaccugccagaccccgaagggggccaucaacaccucccuccccuuccagaacauccaccccaucaccaucggcaagugccccaaguacgucaagucgaccaagcugcggcuggccacggggcuccgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacccuggacuaccacgacucgaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 12114 - RNA, 1701 nt, Artificial Sequence
  derived and/or modified CDS sequence (AUadapt) from InfluenzaA__AHM98847__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacgacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 12115 - RNA, 1701 nt, Artificial Sequence; identical to SEQ ID NO: 7069
  derived and/or modified CDS sequence (AUadapt) from InfluenzaA__AHM98858__HA

SEQ ID NO: 12116 - RNA, 1701 nt, Artificial Sequence; identical to SEQ ID NO: 7112
  derived and/or modified CDS sequence (AUadapt) from InfluenzaA__AHM98877__HA

SEQ ID NO: 12117 - RNA, 1701 nt, Artificial Sequence
  derived and/or modified CDS sequence (AUadapt) from InfluenzaA__AHM98898__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12118 - RNA, 1701 nt, Artificial Sequence; identical to SEQ ID NO: 10695
  derived and/or modified CDS sequence (AUadapt) from InfluenzaA__AHM98909__HA

SEQ ID NO: 12119 - RNA, 1701 nt, Artificial Sequence
  derived and/or modified CDS sequence (AUadapt) from InfluenzaA__AHM98932__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagagccuguccaccgccucguccuggagcuacaucguggagaccuccucguccgacaacggcacgugcuaccccggggacuucaucgacuacgaggagcuccgcgagcagcugagcuccgugucguccuucgagcgguucgagaucuuccccaagaccagcuccuggcccaaccacgacucgaacaagggcgucaccgccgccugcccgcacgccggggcgaaguccuucuacaagaaccugaucuggcucgugaagaagggcgacagcuaccccaagcuguccaagucguacaucaacgacaaggggaaggaggugcugguccucuggggcauccaccaccccagcaccuccgccgaccagcagucgcuguaccagaacgccgacgccuacguguucgugggcuccagccgcuacuccaagaaguucaagcccgagaucgccauccggccgaagguccgcgaccgggaggggcgcaugaacuacuacuggacgcugguggagcccggcgacaagaucaccuucgaggcgaccgggaaccucguggucccccgguacgccuucgccauggagcgcaacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 12120 - RNA, 1701 nt, Artificial Sequence; identical to SEQ ID NO: 12119
  derived and/or modified CDS sequence (AUadapt) from InfluenzaA__AHM98940__HA

SEQ ID NO: 12121 - RNA, 1701 nt, Artificial Sequence; identical to SEQ ID NO: 12119
  derived and/or modified CDS sequence (AUadapt) from InfluenzaA__AHM98951__HA

SEQ ID NO: 12122 - RNA, 1701 nt, Artificial Sequence
  derived and/or modified CDS sequence (AUadapt) from InfluenzaA__AHM98975__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgagucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 12123 - RNA, 1701 nt, Artificial Sequence
  derived and/or modified CDS sequence (AUadapt) from InfluenzaA__AHM98997__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaagggggacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgucgauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgacggggugaagcucgaguccacccgcaucuaccagauccuggcgaucuacagcaccgucgccucgucccuggugcucguggucagccugggcgccaucuccuucuggaugugcagcaacggcucccugcagugccggaucugcaucuga

SEQ ID NO: 12124 - RNA, 1701 nt, Artificial Sequence
  derived and/or modified CDS sequence (AUadapt) from InfluenzaA__AHM99019__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgcgagcagcugagcuccgugucguccuucgagcgguucgagaucuuccccaagaccagcuccuggcccaaccacgacucgaacaagggggucaccgccgccugcccgcacgccggcgcgaaguccuucuacaagaaccugaucuggcucgugaagaagggggacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgcuacuccaagaaguucaagcccgagaucgccauccggccgaagguccgcggccaggaggggcggaugaacuacuacuggacgcugguggagcccggcgacaagaucaccuucgaggcgaccgggaaccucguggucccccgcuacgccuucgccauggagcggaacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcgccucgcgaccgggcugcggaacgucccgucgauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacucggucaucgagaagaugaacacccaguucaccgccgugggcaaggaguucaaccaccuggagaagcggaucgagaaccugaacaagaaggucgacgacggguuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgaggagaucgacggggugaagcucgaguccacccggaucuaccagauccuggcgaucuacagcaccgucgccucgucccuggugcucguggucagccugggcgccaucuccuucuggaugugcagcaacggcucccugcagugccgcaucugcaucuga

SEQ ID NO: 12125 - RNA, 1701 nt, Artificial Sequence; identical to SEQ ID NO: 12124
  derived and/or modified CDS sequence (AUadapt) from InfluenzaA__AHM99031__HA

SEQ ID NO: 12126 - RNA, 1701 nt, Artificial Sequence; identical to SEQ ID NO: 12124
  derived and/or modified CDS sequence (AUadapt) from InfluenzaA__AHM99043__HA

SEQ ID NO: 12127 - RNA, 1701 nt, Artificial Sequence; identical to SEQ ID NO: 12124
  derived and/or modified CDS sequence (AUadapt) from InfluenzaA__AHM99054__HA

SEQ ID NO: 12128 - RNA, 1701 nt, Artificial Sequence; identical to SEQ ID NO: 12124
  derived and/or modified CDS sequence (AUadapt) from InfluenzaA__AHM99065__HA

SEQ ID NO: 12129 - RNA, 1701 nt, Artificial Sequence
  derived and/or modified CDS sequence (AUadapt) from InfluenzaA__AHM99075__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaagggggacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 12130 - RNA, 1701 nt, Artificial Sequence
  derived and/or modified CDS sequence (AUadapt) from InfluenzaA__AHN00717__HA
augaaggccauccugcucgugcugcugugcaccuucgccgcgaccaacgccgacacgcucugcaucggcuaccacgccaacaacucgaccgacaccgucgacaccgugcuggagaagaacgugacggucacccacuccgugaaccugcucgaggaccgccacaacgggaagcugugcaagcugggcgggaucgcgccccuccaccugggcaagugcaacaucgccggguggcugcucggcaacccggagugcgagcugcuguucaccgugucguccuggagcuacaucgucgagaccuccaacucggacaacggcacgugcuaccccggggacuucaucaacuacgaggagcuccgggagcagcuguccagcguguccucguucgagcgcuucgagaucuuccccaagaccuccagcuggcccaaccacgagaccaaccggggcgugaccgccgccugcccguacgccggggccaacuccuucuaccgcaaccugaucuggcucgucaagaagggcaacucguaccccaagcuguccaagagcuacgugaacaacaaggggaaggaggugcugguccucuggggcauccaccacccgcccacguccaccgaccagcagucgcuguaccagaacgcggacgccuacguguucgugggcuccagcaaguacaaccggaaguucaagcccgagaucgccgcccgccccaagguccgggggcaggccggccgcaugaacuacuacuggacccugaucgagcccggggacaccaucacguucgaggcgaccggcaaccucguggugccccgguacgccuucgccaugaaccgcggcccggggucgggcaucaucaucuccgacgcccccguccacgacugcaacacgaccugccagacccccaagggggccaucaacaccagccugcccuuccagaacauccacccggugaccaucggcgagugccccaaguacgugaaguccaccaagcugcggauggcgacggggcuccgcaacauccccucgauccagucccggggccuguucggcgccaucgccggguucaucgagggcggguggaccggcaugaucgacgggugguacggcuaccaccaccagaacgagcagggcagcggguacgccgccgaccagaaguccacccagaacgcgaucgacggcaucaccaacaaggucaacucggugaucaagaagaugaacacgcaguucaccgccguggggaaggaguucaaccaccuggagaagcgcaucgagaaccucaacaagaaggucgacgacggcuuccuggacguguggaccuacaacgccgagcugcucguccugcuggagaacgagcggacccucgacuuccacgacuccaacgugaagaaccuguacgagaaggugcgcagccagcugcggaacaacgccaaggagaucgggaacggcugcuucgaguucuaccacaagugcgacgacacgugcauggaguccgucaagaacggcaccuacgacuaccccaaguacucggaggaguccaagcucaaccgcgaggagaucgacggggugaagcuggagagcacccggaucuaccagauccuggccaucuacuccaccgcggccucgucccucgugcugcuggucagccucggcgccaucuccuucuggaugugcucgaacgggagccugcagugccgcaucugcaucuga

SEQ ID NO: 12131 - RNA, 1701 nt, Artificial Sequence
  derived and/or modified CDS sequence (AUadapt) from InfluenzaA__AHN00764__HA
augaaggccauccugcucgugcugcugugcaccuucgccgcgaccaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugggcgggaucgcgccccuccaccugggcaagugcaacaucgccggguggcugcucggcaacccggagugcgagcugcuguucaccgugucguccuggagcuacaucgucgagaccuccaacucggacaacggcacgugcuaccccggggacuucaucaacuacgaggagcuccgcgagcagcuguccagcguguccucguucgagcgguucgagaucuuccccaagaccuccagcuggcccaaccacgagaccaaccgcggcgugaccgccgccugcccguacgccggggccaacuccuucuaccggaaccugaucuggcucgucaagaagggcaacucguaccccaagcuguccaagagcuacgugaacaacaaggggaaggaggugcugguccucuggggcauccaccacccgcccacguccaccgaccagcagucgcuguaccagaacgcggacgccuacguguucgugggcuccagcaaguacaaccgcaaguucaagcccgagaucgccgcccggcccaagguccgcgggcaggccggccggaugaacuacuacuggacccugaucgagcccggggacaccaucacguucgaggcgaccggcaaccucguggugccccgcuacgccuucgccaugaaccggggcccggggucgggcaucaucaucuccgacgcccccguccacgacugcaacacgaccugccagacccccaagggggccaucaacaccagccugcccuuccagaacauccacccggugaccaucggcgagugccccaaguacgugaaguccaccaagcugcgcauggcgacggggcuccggaacauccccucgauccagucccgcggccuguucggcgccaucgccggguucaucgagggcggguggaccggcaugaucgacgggugguacggcuaccaccaccagaacgagcagggcagcggguacgccgccgaccagaaguccacccagaacgcgaucgacggcaucaccaacaaggucaacucggugaucaagaagaugaacacgcaguucaccgccguggggaaggaguucaaccaccuggagaagcggaucgagaaccucaacaagaaggucgacgacggcuuccuggacguguggaccuacaacgccgagcugcucguccugcuggagaacgagcgcacccucgacuuccacgacuccaacgugaagaaccuguacgagaaggugcggagccagcugcgcaacaacgccaaggagaucgggaacggcugcuucgaguucuaccacaagugcgacgacacgugcauggaguccgucaagaacggcaccuacgacuaccccaaguacucggaggaguccaagcucaaccgggaggagaucgacggggugaagcuggagagcacccgcaucuaccagauccuggccaucuacuccaccgcggccucgucccucgugcugcuggucagccucggcgccaucuccuucuggaugugcucgaacgggagccugcagugccggaucugcaucuga

SEQ ID NO: 12132 - RNA, 1683 nt, Artificial Sequence
  derived and/or modified CDS sequence (AUadapt) from InfluenzaA__AHN96323__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuucucgaguucagcgccgaccugaucaucgagcgccgggaaggguccgacgugugcuaccccggcaaguucgugaacgaggaggcccugcgccagauccuccgggagagugggggcaucgacaaggaggcgaugggguucaccuacuccggcauccgcaccaacggcgccaccagcgccugccggcgcuccgggagcuccuucuaugccgagaugaaguggcugcugagcaacacggacaacgcggccuucccgcagaugaccaaguccuacaagaacacccgcaagagccccgcccucaucgucuggggcauccaucacuccgugagcaccgccgagcaaacgaagcuguacggguccggcaacaagcuggugaccgucggcagcuccaacuaccagcagagcuuugugcccucccccggggcccggccccaggugaacggccucagcgggcggaucgacuuccacuggcugaugcugaaccccaacgacaccgucaccuuuagcuucaacggcgcguucaucgcccccgaccgcgccuccuuccuccggggcaagagcauggggauccaguccggcguccagguggacgccaauugcgagggggacugcuaccacagcggcgggacgaucaucuccaaccugcccuuucagaacaucgacagccgcgccgugggcaagugcccgcgguacgugaagcagcgcucccugcuccuggcgaccgggaugaagaacgugcccgaaauccccaagggccggggccuguucggggccaucgccggcuucaucgagaaugggugggagggccucaucgacgggugguacggcuuccgccaccagaacgcccagggcgaggggaccgccgcggacuacaagagcacccaguccgccaucgaucagaucacgggcaagcugaaccggcugaucgagaagaccaaccagcaauucgagcucaucgacaacgaguucaacgaggucgagaagcagaucgggaacgugaucaauuggacccgcgacagcaucaccgaggugugguccuacaacgccgagcugcuggucgccauggagaaccagcacacgaucgaccucgccgacagugagauggacaagcuguacgagcgcgugaagcggcaacugcgcgagaacgcggaggaggacggcaccggcugcuucgagaucuuccacaagugugacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucgggaucuga

SEQ ID NO: 12133 - RNA, 1701 nt, Artificial Sequence; identical to SEQ ID NO: 7227
  derived and/or modified CDS sequence (AUadapt) from InfluenzaA__AHN96442__HA

SEQ ID NO: 12134 - RNA, 1701 nt, Artificial Sequence
  derived and/or modified CDS sequence (AUadapt) from InfluenzaA__AHN96443__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacacgagccugcggucccucgucgcgucguccggcacccuggaguucaacaacgagagcuucaacuggaccggggugacccagaacggcacguccucggccugcauccgccgguccaacaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggcggaucacgguguccaccaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggccugcaucacgcccaacggcuccauccccaacgacaagccguuccagaacgucaaccgcaucaccuacggggcgugcccccgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggcgugccagaaggggaacauccggugcaacaucugcaucuga

SEQ ID NO: 12135 - RNA, 1701 nt, Artificial Sequence
  derived and/or modified CDS sequence (AUadapt) from InfluenzaA__AHN96444__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaaccagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaaggggaucgagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 12136 - RNA, 1701 nt, Artificial Sequence
  derived and/or modified CDS sequence (AUadapt) from InfluenzaA__AHN96445__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgugacgaugcccaacaaccagcaguucgacaagcucuacaucuggggcguccaccaccccgggaccgacaaggaccagaucuuccuguacgcgcaguccucggggcgcaucaccguguccaccaagcggagccagcaggccgugaucccgaacaucggcucgcgcccccggauccgcaacauccccucccggaucagcaucuacuggacgaucgucaagcccggcgacauccugcucaucaacuccaccgggaaccugaucgccccgcgcggcuacuucaagauccugagcgggaaguccucgaucaugcgguccgacgcccccaucggcaagugcaagagcgagugcaucacccccaacggcuccauccccaacgacaagccguuccagaacgugaaccgcaucaccuacggggccugcccccgguacgugaagcagucgacgcucaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcguggcccuccugggcuucaucaugugggccugccagaaggggaacauccggugcaacaucugcaucuga

SEQ ID NO: 12137 - RNA, 1701 nt, Artificial Sequence
  derived and/or modified CDS sequence (AUadapt) from InfluenzaA__AHN96447__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 12138 - RNA, 1701 nt, Artificial Sequence
  derived and/or modified CDS sequence (AUadapt) from InfluenzaA__AHV83765__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaccaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12139 - RNA, 1701 nt, Artificial Sequence; identical to SEQ ID NO: 11266
  derived and/or modified CDS sequence (AUadapt) from InfluenzaA__AHV83766__HA

SEQ ID NO: 12140 - RNA, 1701 nt, Artificial Sequence; identical to SEQ ID NO: 10285
  derived and/or modified CDS sequence (AUadapt) from InfluenzaA__AHV83767__HA

SEQ ID NO: 12141 - RNA, 1701 nt, Artificial Sequence
  derived and/or modified CDS sequence (AUadapt) from InfluenzaA__AHV83768__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugcucgagcccggggacaagaucacguucgaggccaccggcaaccugguggugccccgguacgcguucaccauggagcgcaacgccgggucgggcaucaucaucuccgacacccccguccacgacugcaacacgaccugccagaccccggagggcgccaucaacaccagccugcccuuccagaacauccaccccaucacgaucgggaagugccccaaguacgugaaguccaccaagcuccggcuggccaccggccugcgcaacgugccgucgauccagucccggggccucuucggcgccaucgcgggguucaucgagggcggcuggaccgggauggucgacggcugguacggguaccaccaccagaacgagcagggcagcggguacgccgccgaccugaaguccacgcagaacgccaucgacaagaucaccaacaaggugaacucggugaucgagaagaugaacacccaguucaccgccgucggcaaggaguucaaccaccuggagaagcgcaucgagaaccucaacaagaagguggacgacggcuuccuggacaucuggacguacaacgcggagcugcucguccugcuggagaacgagcggacccucgacuaccacgacuccaacgugaagaaccuguacgagaaggugcgcaaccagcugaagaacaacgccaaggagaucgggaacggcugcuucgaguucuaccacaagugcgacaacacgugcauggacucggucaagaacgggaccuacgacuaccccaaguacuccgaggaggccaagcucaaccgggagaagaucgacggcgugaagcuggagagcacccgcaucuaccagauccuggccaucuacuccaccguggccucgucccucguccugguggugagccugggggcgaucucguucuggaugugcuccaacggcagccuccagugccggaucugcaucuga

SEQ ID NO: 12142 - RNA, 1701 nt, Artificial Sequence; identical to SEQ ID NO: 11243
  derived and/or modified CDS sequence (AUadapt) from InfluenzaA__AHV83770__HA

SEQ ID NO: 12143 - RNA, 1701 nt, Artificial Sequence
  derived and/or modified CDS sequence (AUadapt) from InfluenzaA__AHV83771__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacgaccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcucgggguacgccgccgaccagaaguccacgcagaacgccaucgacaagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgccaucuacuccaccgucgccucgucccuggugcugguggucagccucggggcgaucucguucuggaugugcuccaacggcagccugcagugccggaucugcaucuga

SEQ ID NO: 12144 - RNA, 1701 nt, Artificial Sequence; identical to SEQ ID NO: 10285
  derived and/or modified CDS sequence (AUadapt) from InfluenzaA__AHV83772__HA

SEQ ID NO: 12145 - RNA, 1701 nt, Artificial Sequence; identical to SEQ ID NO: 10285
  derived and/or modified CDS sequence (AUadapt) from InfluenzaA__AHV83773__HA

SEQ ID NO: 12146 - RNA, 1701 nt, Artificial Sequence; identical to SEQ ID NO: 10285
  derived and/or modified CDS sequence (AUadapt) from InfluenzaA__AHV83774__HA

SEQ ID NO: 12147 - RNA, 1701 nt, Artificial Sequence
  derived and/or modified CDS sequence (AUadapt) from InfluenzaA__AHV83775__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12148 - RNA, 1701 nt, Artificial Sequence; identical to SEQ ID NO: 10285
  derived and/or modified CDS sequence (AUadapt) from InfluenzaA__AHV83776__HA

SEQ ID NO: 12149 - RNA, 1701 nt, Artificial Sequence
  derived and/or modified CDS sequence (AUadapt) from InfluenzaA__AHV83777__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacaucccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagucgacccgcaucuaccagauccuggccaucuacuccaccguggcgagcucccugguccucguggugucgcugggggccaucugcuucuggaugugcagcaacggcucccugcagugccggaucugcaucuga

SEQ ID NO: 12150 - RNA, 1701 nt, Artificial Sequence
  derived and/or modified CDS sequence (AUadapt) from InfluenzaA__AHV83778__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccguguacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcucgggguacgccgccgaccucaaguccacgcagaacgccaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12151 - RNA, 1701 nt, Artificial Sequence
  derived and/or modified CDS sequence (AUadapt) from InfluenzaA__AHV83779__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcucgggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12152 - RNA, 1701 nt, Artificial Sequence
  derived and/or modified CDS sequence (AUadapt) from InfluenzaA__AHV83780__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugcggcaguccuacaucaacgacaagggcaaggaggugcugguccucugggggauccaccaccccagcaccacgaccgaccagcagucgcuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagucgaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgagaagaucgacggcgugaagcucgaguccacccggaucuaccagauccuggccaucuacucgaccgucgccuccagccuggugcucguggucucccugggggcgaucucguucuggaugugcagcaacggcucccugcagugccgcaucugcaucuga

SEQ ID NO: 12153 - RNA, 1701 nt, Artificial Sequence; identical to SEQ ID NO: 10285
  derived and/or modified CDS sequence (AUadapt) from InfluenzaA__AHV83781__HA

SEQ ID NO: 12154 - RNA, 1701 nt, Artificial Sequence
  derived and/or modified CDS sequence (AUadapt) from InfluenzaA__AHV83782__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccucguccuggcccaaccacgacagcaacaagggggucaccgccgccugcccgcacgccggcgcgaaguccuucuacaagaaccucaucuggcuggugaagaaggggaacucguaccccaagcugucccagucguacaucaacgacaagggcaaggaggugcucguccugugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucaccuucgaggcgacgggcaaccugguggcgccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgugccgucgauccagucccggggccucuucggggccaucgccggguucaucgagggcggcuggaccgggauggucgacggcugguacggguaccaccaccagaacgagcagggcucgggguacgccgccgaccugaaguccacccagaacgcgaucgacaagaucacgaacaaggugaacagcgugaucgagaagaugaacacccaguucaccgccgucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacuccaacgugaagaaccuguacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgggagaagaucgacggcgugaagcuggagucgacccgcaucuaccagauccuggcgaucuacuccaccguggccagcucccucguccugguggugucgcugggggccaucucguucuggaugugcuccaacggcagccuccagugccggaucugcaucuga

SEQ ID NO: 12155 - RNA, 1701 nt, Artificial Sequence
  derived and/or modified CDS sequence (AUadapt) from InfluenzaA__AHV83783__HA
augaaggccauccuggugguccuccuguacaccuucgccaccgcgaacgccgacacgcugugcaucggcuaccacgccaacaacucgaccgacaccguggacaccgugcucgagaagaacaucacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccucguccgacaacggcacgugcuaccccggcgacuucaucaacuacgaggagcuccgggagcagcugagcuccgugucguccuucgagcgcuucgagaucuuccccaagaccucguccuggcccaaccacgacagcaacaagggggugaccgccgccugcccgcacgccggcgcgaagggguucuacaagaaccugaucuggcucgucaagaagggcaacuccuaccccaagcugcggcagucguacaucaacgacaaggggaaggaggugcuggugcucuggggcauccaccaccccuccaccacgaccgaccagcagucgcuguaccagaacgccgacgccuacgucuucgugggcaccagccgcuacuccaagaaguucaagcccgagaucgccauccggccgaaggugcgcgaccaggaggggcggaugaacuacuacuggacccuggucgagcccggcgacaagaucacguucgaggccaccgggaaccucguggugccccgcuacgcguucaccauggagcggaacgccggcucgggcaucaucaucuccgacacccccguccacgacugcaacacgaccugccagaccccggagggggccaucaacaccucgcugcccuuccagaacauccaccccaucacgaucggcaagugccccaaguacgugaaguccaccaagcugcgccucgccaccgggcugcggaacgugccgagcauccagucccgcggccuguucggggccaucgcgggcuucaucgagggcggguggaccggcauggucgacgggugguacggcuaccaccaccagaacgagcaggggucgggcuacgccgccgaccucaaguccacgcagaacgccaucgacaagaucaccaacaaggugaacucggugaucgagaagaugaacacccaguucaccgccgucggcaaggaguucaaccaccuggagaagcggaucgagaaccugaacaagaagguggacgacggguuccucgacaucuggacguacaacgcggagcugcugguccuccuggagaacgagcgcacccuggacuaccacgacuccaacgugaagaaccucuacgagaaggugcggaaccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgcgagaagaucgacggggugaagcucgagucgacccggaucuaccagauccuggccaucuacuccaccguggccucgucccugguccucguggugagccugggcgcgaucuccuucuggaugugcucgaacggcagccugcagugccgcaucugcaucuga

SEQ ID NO: 12156 - RNA, 1701 nt, Artificial Sequence; identical to SEQ ID NO: 10285
  derived and/or modified CDS sequence (AUadapt) from InfluenzaA__AHV83784__HA

SEQ ID NO: 12157 - RNA, 1701 nt, Artificial Sequence; identical to SEQ ID NO: 10285
  derived and/or modified CDS sequence (AUadapt) from InfluenzaA__AHV83785__HA

SEQ ID NO: 12158 - RNA, 1701 nt, Artificial Sequence; identical to SEQ ID NO: 10285
  derived and/or modified CDS sequence (AUadapt) from InfluenzaA__AHV83787__HA

SEQ ID NO: 12159 - RNA, 1701 nt, Artificial Sequence
  derived and/or modified CDS sequence (AUadapt) from InfluenzaA__AHV83788__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucucgccccugcaccucgggaagugcaacaucgccggcuggauccuggggaacccggagugcgagucccugagcaccgccuccucgugguccuacaucguggagaccagcuccucggacaacggcacgugcuaccccggcgacuucgugaacuacgaggagcuccgggagcagcuguccagcgucuccucguucgagcgcuucgagaucuuccccaagaccuccagcuggcccaaccacgacuccaacaagggggugaccgcggccugcccgcacgccggcgccaagucguucuacaagaaccugaucuggcucgugaagaaggggaacuccuaccccaagcugagccagucguacaucaacgacaagggcaaggagguccuggugcucugggggauccaccaccccuccaccacggcggaccagcagucgcuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacucgaacgucaagaaccucuacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgucaagcucgaguccacccgcaucuaccagauccuggccaucuacucgaccguggccuccagccuggugcucgucgugucgcugggggcgaucuccuucuggaugugcagcaacggcucccugcagugccggaucugcaucuga

SEQ ID NO: 12160 - RNA, 1701 nt, Artificial Sequence; identical to SEQ ID NO: 12147
  derived and/or modified CDS sequence (AUadapt) from InfluenzaA__AHV83789__HA

SEQ ID NO: 12161 - RNA, 1701 nt, Artificial Sequence; identical to SEQ ID NO: 10285
  derived and/or modified CDS sequence (AUadapt) from InfluenzaA__AHV83790__HA

SEQ ID NO: 12162 - RNA, 1701 nt, Artificial Sequence; identical to SEQ ID NO: 10285
  derived and/or modified CDS sequence (AUadapt) from InfluenzaA__AHV83791__HA

SEQ ID NO: 12163 - RNA, 1701 nt, Artificial Sequence; identical to SEQ ID NO: 10285
  derived and/or modified CDS sequence (AUadapt) from InfluenzaA__AHV83792__HA

SEQ ID NO: 12164 - RNA, 1701 nt, Artificial Sequence
  derived and/or modified CDS sequence (AUadapt) from InfluenzaA__AHV83793__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagaaguucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggagauccuggugcucugggggauccaccaccccucgaccacggccgaccagcagucccuguaccagaacgccgacgccuacgucuucgugggcaccucgcgcuacuccaagaaguucaagcccgagaucgccauccggccgaaggugcgcgaccaggagggccggaugaacuacuacuggacccuggucgagcccggggacaagaucaccuucgaggcgacgggcaaccucguggugccccgcuacgccuucaccauggagcggaacgccgggagcggcaucaucaucuccgacacccccguccacgacugcaacaccacgugccagaccccggagggcgccaucaacaccucgcugcccuuccagaacauccaccccaucaccaucgggaagugccccaaguacgugaaguccacgaagcugcgccucgccaccggccugcggaacgugccgagcauccagucccgcgggcuguucggcgcgaucgccggguucaucgagggcggcuggaccgggauggucgacggcugguacggguaccaccaccagaacgagcagggcucgggguacgccgccgaccagaaguccacccagaacgccaucgacaagaucacgaacaaggugaacucggugaucgagaagaugaacacccaguucaccgcggucggcaaggaguucaaccaccucgagaagcggaucgagaaccugaacaagaagguggacgacggcuuccuggacaucuggaccuacaacgccgagcuccugguccugcucgagaacgagcgcacgcuggacuaccacgacuccaacgugaagaaccuguacgagaaggugcggaaccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgcgagaagaucgacggcgugaagcuggagucgacccggaucuaccagauccucgccaucuacuccaccguggcgucgucccugguccugguggugagccucggggccaucucguucuggaugugcuccaacggcagccugcagugccgcaucugcaucuga

SEQ ID NO: 12165 - RNA, 1701 nt, Artificial Sequence
  derived and/or modified CDS sequence (AUadapt) from InfluenzaA__AHV83794__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccagaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgccaucuacuccaccgucgcgucgucccuggugcugguggucagccucggggccaucucguucuggaugugcuccaacggcagccugcagugccggaucugcaucuga

SEQ ID NO: 12166 - RNA, 1701 nt, Artificial Sequence
  derived and/or modified CDS sequence (AUadapt) from InfluenzaA__AHV83795__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccgccgccagcuccuggucguacaucguggagaccuccucguccgacaacgggaccugcuaccccggcgacuucaucaacuacgaggagcuccgggagcagcugagcuccgugucguccuucgagcgcuucgagaucuuccccaagacgagcuccuggcccaaccacgacucgaacaagggcgucaccgccgccugcccgcacgcgggcgccaaguccuucuacaagaaccugaucuggcucgugaagaaggggaacucguaccccaagcugucccagagcuacaucaacgacaagggcaaggaggugcugguccucugggggauccaccaccccucgaccaccgccgaccagcagucccuguaccagaacgccgacacguacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccagaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgaccaagaucuaccagauccucgccaucuacuccaccgucgcgucgucccuggugcugguggucagccucggggccaucucguucuggaugugcuccaacggcagccugcagugccgcaucugcaucuga

SEQ ID NO: 12167 - RNA, 1701 nt, Artificial Sequence; identical to SEQ ID NO: 12165
  derived and/or modified CDS sequence (AUadapt) from InfluenzaA__AHV83796__HA

SEQ ID NO: 12168 - RNA, 1701 nt, Artificial Sequence; identical to SEQ ID NO: 10285
  derived and/or modified CDS sequence (AUadapt) from InfluenzaA__AHV83798__HA

SEQ ID NO: 12169 - RNA, 1701 nt, Artificial Sequence; identical to SEQ ID NO: 10285
  derived and/or modified CDS sequence (AUadapt) from InfluenzaA__AHV83799__HA

SEQ ID NO: 12170 - RNA, 1701 nt, Artificial Sequence
  derived and/or modified CDS sequence (AUadapt) from InfluenzaA__AHV83800__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagaagacgcuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgucccuggugcucguggucagccugggggccaucucguucuggaugugcuccaacggcagccugcagugccgcaucugcaucuga

SEQ ID NO: 12171 - RNA, 1701 nt, Artificial Sequence
  derived and/or modified CDS sequence (AUadapt) from InfluenzaA__AHV83801__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccagaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgaccaagaucuaccagauccucgccaucuacuccaccgucgcgucgucccuggugcugguggucagccucggggccaucucguucuggaugugcuccaacggcagccugcagugccgcaucugcaucuga

SEQ ID NO: 12172 - RNA, 1701 nt, Artificial Sequence
  derived and/or modified CDS sequence (AUadapt) from InfluenzaA__AHV83802__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagggccuguaccagaacguggacgccuacguguucgucggcaccucccgguacucgaagaaguucaagcccgagaucgccauccgcccgaaggugcgggaccaggaggggcgcaugaacuacuacuggacccugguggagcccggcgacaagaucaccuucgaggccacggggaaccucgucgugccccgguacgcguucaccauggagcgcaacgccggcuccggcaucaucaucagcgacacccccgugcacgacugcaacaccacgugccagaccccggagggggccaucaacaccucccugcccuuccagaacauccaccccaucaccaucggcaagugccccaaguacgucaagucgacgaagcugcggcucgccaccgggcugcgcaacgugccguccauccagucgcggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggguuccucgacaucuggaccuacaacgcggagcugcuggugcuccuggagaacgagcggacgcuggacuaccacgacucgaacgucaagaaccucuacgagaaggugcgcaaccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggagaagaucgacggggucaagcucgaguccacccgcaucuaccagauccuggccaucuacucgaccguggccuccagccuggugcucgucgugucccugggcgcgaucucguucuggaugugcagcaacggcucccugcagugccggaucugcaucuga

SEQ ID NO: 12173 - RNA, 1701 nt, Artificial Sequence; identical to SEQ ID NO: 10285
  derived and/or modified CDS sequence (AUadapt) from InfluenzaA__AHV83803__HA

SEQ ID NO: 12174 - RNA, 1701 nt, Artificial Sequence; identical to SEQ ID NO: 10285
  derived and/or modified CDS sequence (AUadapt) from InfluenzaA__AHV83804__HA

SEQ ID NO: 12175 - RNA, 1701 nt, Artificial Sequence; identical to SEQ ID NO: 10285
  derived and/or modified CDS sequence (AUadapt) from InfluenzaA__AHV83805__HA

SEQ ID NO: 12176 - RNA, 1701 nt, Artificial Sequence; identical to SEQ ID NO: 12165
  derived and/or modified CDS sequence (AUadapt) from InfluenzaA__AHV83806__HA

SEQ ID NO: 12177 - RNA, 1701 nt, Artificial Sequence
  derived and/or modified CDS sequence (AUadapt) from InfluenzaA__AHV83807__HA
augaaggccauccuggugguccuccuguacaccuucgccaccgcgaacgccgacacgcugugcaucggcuaccacgccaacaacucgaccgacaccguggacaccgugcucgagaaggacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12178 - RNA, 1701 nt, Artificial Sequence
  derived and/or modified CDS sequence (AUadapt) from InfluenzaA__AHV83808__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgaggccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacaugugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12179 - RNA, 1701 nt, Artificial Sequence; identical to SEQ ID NO: 10285
  derived and/or modified CDS sequence (AUadapt) from InfluenzaA__AHV83809__HA

SEQ ID NO: 12180 - RNA, 1701 nt, Artificial Sequence; identical to SEQ ID NO: 11266
  derived and/or modified CDS sequence (AUadapt) from InfluenzaA__AHV83810__HA

SEQ ID NO: 12181 - RNA, 1701 nt, Artificial Sequence
  derived and/or modified CDS sequence (AUadapt) from InfluenzaA__AHV83812__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgaguaccccaaguacuccgaggaggccaagcugaaccgggagaagaucgacggcgugaagcucgagagcaccaagaucuaccagauccuggccaucuacuccaccgucgccucgucccuggugcucguggucagccugggggcgaucucguucuggaugugcuccaacggcagccugcagugccgcaucugcaucuga

SEQ ID NO: 12182 - RNA, 1701 nt, Artificial Sequence; identical to SEQ ID NO: 10285
  derived and/or modified CDS sequence (AUadapt) from InfluenzaA__AHV83813__HA

SEQ ID NO: 12183 - RNA, 1701 nt, Artificial Sequence
  derived and/or modified CDS sequence (AUadapt) from InfluenzaA__AHV83814__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggaaccuggacuaccacgacuccaacgugaagaaccucuacgagaagguccgcaaccagcugaagacgaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12184 - RNA, 1701 nt, Artificial Sequence; identical to SEQ ID NO: 11266
  derived and/or modified CDS sequence (AUadapt) from InfluenzaA__AHV83815__HA

SEQ ID NO: 12185 - RNA, 1701 nt, Artificial Sequence; identical to SEQ ID NO: 10285
  derived and/or modified CDS sequence (AUadapt) from InfluenzaA__AHV83816__HA

SEQ ID NO: 12186 - RNA, 1701 nt, Artificial Sequence
  derived and/or modified CDS sequence (AUadapt) from InfluenzaA__AHV83817__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugguguggcucgugaagaaggggaacagcuaccccaagcugucccagucguacaucaacgacaagggcaaggagguccuggugcucugggggauccaccaccccagcaccacggccgaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggcgacgggcaaccucgucgugccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 12187 - RNA, 1701 nt, Artificial Sequence; identical to SEQ ID NO: 12165
  derived and/or modified CDS sequence (AUadapt) from InfluenzaA__AHV83818__HA

SEQ ID NO: 12188 - RNA, 1701 nt, Artificial Sequence; identical to SEQ ID NO: 12147
  derived and/or modified CDS sequence (AUadapt) from InfluenzaA__AHV83819__HA

SEQ ID NO: 12189 - RNA, 1701 nt, Artificial Sequence
  derived and/or modified CDS sequence (AUadapt) from InfluenzaA__AHV83821__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucucgccccugcaccucgggaagugcaacaucgccggcuggauccuggggaacccggagugcgagucccugagcaccgccuccucgugguccuacaucguggagaccagcuccucggacaacggcacgugcuaccccggcgacuucgugaacuacgaggagcuccgggagcagcuguccagcgucuccucguucgagcgcuucgagaucuuccccaagaccuccagcuggcccaaccacgacuccaacaagggggugaccgcggccugcccgcacgccggcgccaagucguucuacaagaaccugaucuggcucgugaagaaggggaacuccuaccccaagcugagccagucguacaucaacgacaagggcaaggagguccuggugcucugggggauccaccaccccuccaccacggcggaccagcagucgcuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccggguccggcaucaucaucucggacacccccgugcacaacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacucgaacgucaagaaccucuacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgucaagcucgaguccacccgcaucuaccagauccuggccaucuacucgaccguggccuccagccuggugcucgucgugucgcugggggcgaucuccuucuggaugugcagcaacggcucccugcagugccggaucugcaucuga

SEQ ID NO: 12190 - RNA, 1701 nt, Artificial Sequence
  derived and/or modified CDS sequence (AUadapt) from InfluenzaA__AHV83822__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucucgccccugcaccucgggaagugcaacaucgccggcuggauccuggggaacccggagugcgagucccugagcaccgccuccucgugguccuacaucguggagaccagcuccucggacaacggcacgugcuaccccggcgacuucgugaacuacgaggagcuccgggagcagcuguccagcgucuccucguucgagcgcuucgagaucuuccccaagaccuccagcuggcccaaccacgacuccaacaagggggugaccgcggccugcccgcacgccggcgccaagucguucuacaagaaccugaucuggcucgugaagaaggggaacuccuaccccaagcugagccagucguacaucaacgacaagggcaaggagguccuggugcucugggggauccaccaccccuccaccacggcggaccagcagucgcuguaccagaacgccgacgccuacguguucgucggcaccucccgguacagcaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggucaacuccaucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgccuccagccuggugcucguggucucgcugggggcgaucuccuucuggaugugcagcaacggcucccugcagugccggaucugcaucuga

SEQ ID NO: 12191 - RNA, 1701 nt, Artificial Sequence
  derived and/or modified CDS sequence (AUadapt) from InfluenzaA__AHV83823__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagaucucccagucguacaucaacgacaagggcaaggaggugcugguccugugggggauccaccaccccagcaccacggccgaccagcagucccucuaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacaccgggucgggcaucaucaucuccgacacccccgugcacgacugcaacacgaccugccagaccccggagggcgccaucaacaccagccuccccuuccagaacauccaccccaucacgaucgggaagugccccaaguacgugaaguccaccaagcugcggcuggccaccggccuccgcaacgucccgucgauccagucccgggggcuguucggcgccaucgcgggguucaucgagggcggcuggaccgggaugguggacggcugguacggguaccaccaccagaacgagcagggcagcggguacgccgccgaccugaaguccacgcagaacgccaucgacaagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcuggagagcacccgcaucuaccagauccucgccaucuacuccaccgucgccucgucccuggugcugguggucagccucggggcgaucucguucuggaugugcuccaacggcagccugcagugccggaucugcaucuga

SEQ ID NO: 12192 - RNA, 1701 nt, Artificial Sequence
  derived and/or modified CDS sequence (AUadapt) from InfluenzaA__AHV83824__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugcggcaguccuacaucaacgacaagggcaaggaggugcugguccucugggggauccaccaccccagcaccacgaccgaccagcagucgcuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagucgaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcaaccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgagaagaucgacggcgugaagcucgaguccacccggaucuaccagauccuggccaucuacucgaccgucgccuccagccuggugcucguggucucccugggggcgaucucguucuggaugugcagcaacggcucccugcagugccgcaucugcaucuga

SEQ ID NO: 12193 - RNA, 1701 nt, Artificial Sequence; identical to SEQ ID NO: 12165
  derived and/or modified CDS sequence (AUadapt) from InfluenzaA__AHV83825__HA

SEQ ID NO: 12194 - RNA, 1701 nt, Artificial Sequence
  derived and/or modified CDS sequence (AUadapt) from InfluenzaA__AHV83826__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacuucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgcggccucgucccugguccucguggugagccugggggccaucucguucuggaugugcuccaacggcagccugcagugccggaucugcaucuga

SEQ ID NO: 12195 - RNA, 1701 nt, Artificial Sequence; identical to SEQ ID NO: 10285
  derived and/or modified CDS sequence (AUadapt) from InfluenzaA__AHV83827__HA

SEQ ID NO: 12196 - RNA, 1701 nt, Artificial Sequence; identical to SEQ ID NO: 10285
  derived and/or modified CDS sequence (AUadapt) from InfluenzaA__AHV83828__HA

SEQ ID NO: 12197 - RNA, 1701 nt, Artificial Sequence
  derived and/or modified CDS sequence (AUadapt) from InfluenzaA__AHV83829__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagaucucccagucguacaucaacgacaagggcaaggaggugcugguccugugggggauccaccaccccagcaccacggccgaccagcagucccucuaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacgccgggucgggcaucaucaucuccgacacccccgugcacgacugcaacaccacgugccagaccccggagggcgccaucaacaccagccuccccuuccagaacauccaccccaucaccaucgggaagugccccaaguacgugaaguccacgaagcugcggcuggccaccggccuccgcaacgucccgucgauccagucccgggggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcuggagagcacccgcaucuaccagauccucgccaucuacuccaccgucgcgucgucccuggugcugguggucagccucggggccaucucguucuggaugugcuccaacggcagccugcagugccggaucugcaucuga

SEQ ID NO: 12198 - RNA, 1701 nt, Artificial Sequence; identical to SEQ ID NO: 10285
  derived and/or modified CDS sequence (AUadapt) from InfluenzaA__AHV83830__HA

SEQ ID NO: 12199 - RNA, 1701 nt, Artificial Sequence
  derived and/or modified CDS sequence (AUadapt) from InfluenzaA__AHV83831__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccaucgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccgggagcggcaucaucguguccgacacccccgugcacgacugcaacacgaccugccagaccccggagggcgccaucaacaccucgcugcccuuccagaacauccaccccaucaccaucgggaagugccccaaguacgucaaguccaccaagcugcggcucgccacgggccugcgcaacgugccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucaccaacaaggucaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 12200 - RNA, 1701 nt, Artificial Sequence; identical to SEQ ID NO: 11248
  derived and/or modified CDS sequence (AUadapt) from InfluenzaA__AHV83832__HA

SEQ ID NO: 12201 - RNA, 1701 nt, Artificial Sequence; identical to SEQ ID NO: 10285
  derived and/or modified CDS sequence (AUadapt) from InfluenzaA__AHV83833__HA

SEQ ID NO: 12202 - RNA, 1701 nt, Artificial Sequence; identical to SEQ ID NO: 11266
  derived and/or modified CDS sequence (AUadapt) from InfluenzaA__AHV83834__HA

SEQ ID NO: 12203 - RNA, 1701 nt, Artificial Sequence
  derived and/or modified CDS sequence (AUadapt) from InfluenzaA__AHV83836__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggagaacucguaccccaagcugcggcaguccuacaucaacgacaaggggaaggaggugcugguccucuggggcauccaccaccccagcaccacgaccgaccagcagucgcuguaccagaacgccgacgccuacguguucguggggaccucccgcuacagcaagaaguucaagcccgagaucgccauccggccgaagguccgcgaccaggagggccggaugaacuacuacuggacccugguggagcccggcgacaagaucacguucgaggccaccgggaaccucguggucccccgcuacgcguucaccauggagcggaacgccggcuccgggaucaucaucucggacacccccgugcacgacugcaacacgaccugccagaccccggagggcgccaucaacaccucccugcccuuccagaacauccaccccaucacgaucggcaagugccccaaguacgucaagucgaccaagcugcgccucgccaccgggcugcggaacgugccguccauccagagccgcggccuguucggggccaucgcgggcuucaucgagggcggguggaccggcaugguggacgggugguacggcuaccaccaccagaacgagcagggguccggcuacgccgccgaccucaagucgacgcagaacgccaucgacaagaucaccaacaaggugaacuccgucaucgagaagaugaacacccaguucaccgccguggggaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucggcaacgggugcuucgaguucuaccacaagugcgacaacacgugcauggaguccgugaagaacggcaccuacgacuaccccaaguacucggaggaggccaagcugaaccgcgagaagaucgacggggugaagcucgaguccacccggaucuaccagauccuggccaucuacucgaccgucgccuccagccuggugcucguggucucccugggcgcgaucucguucuggaugugcagcaacgggucccugcagugccgcaucugcaucuga

SEQ ID NO: 12204 - RNA, 1701 nt, Artificial Sequence; identical to SEQ ID NO: 12152
  derived and/or modified CDS sequence (AUadapt) from InfluenzaA__AHV83837__HA

SEQ ID NO: 12205 - RNA, 1701 nt, Artificial Sequence; identical to SEQ ID NO: 10285
  derived and/or modified CDS sequence (AUadapt) from InfluenzaA__AHV83838__HA

SEQ ID NO: 12206 - RNA, 1701 nt, Artificial Sequence; identical to SEQ ID NO: 11248
  derived and/or modified CDS sequence (AUadapt) from InfluenzaA__AHV83839__HA

SEQ ID NO: 12207 - RNA, 1701 nt, Artificial Sequence; identical to SEQ ID NO: 11266
  derived and/or modified CDS sequence (AUadapt) from InfluenzaA__AHV83840__HA

SEQ ID NO: 12208 - RNA, 1701 nt, Artificial Sequence
  derived and/or modified CDS sequence (AUadapt) from InfluenzaA__AHV83841__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugcggcaguccuacaucaacgacaagggcaaggaggugcugguccucugggggauccaccaccccagcaccacgaccgaccagcagucgcuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucucggacacccccgugcacaacugcaacacgaccugccagaccccggagggcgccaucaacaccucccugcccuuccagaacauccaccccaucacgaucgggaagugccccaaguacgucaagucgaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgagaagaucgacggcgugaagcucgaguccacccggaucuaccagauccuggccaucuacucgaccgucgccuccagccuggugcucguggucucccugggggcgaucucguucuggaugugcagcaacggcucccugcagugccgcaucugcaucuga

SEQ ID NO: 12209 - RNA, 1701 nt, Artificial Sequence; identical to SEQ ID NO: 10285
  derived and/or modified CDS sequence (AUadapt) from InfluenzaA__AHV83842__HA

SEQ ID NO: 12210 - RNA, 1701 nt, Artificial Sequence; identical to SEQ ID NO: 10285
  derived and/or modified CDS sequence (AUadapt) from InfluenzaA__AHV83843__HA

SEQ ID NO: 12211 - RNA, 1701 nt, Artificial Sequence; identical to SEQ ID NO: 10285
  derived and/or modified CDS sequence (AUadapt) from InfluenzaA__AHV83844__HA

SEQ ID NO: 12212 - RNA, 1701 nt, Artificial Sequence
  derived and/or modified CDS sequence (AUadapt) from InfluenzaA__AHV83845__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagucguacaucaacgacaagggcaaggaggugcugguccucugggggauccaccacccgcccaccacggccgaccagcagagccuguaccagaacgccgacgccuacguguucgugggcaccucccgguacucgaagaaguucaagcccgagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacaccccggugcacgacugcaacaccacgugccagacccccgagggcgccaucaacaccucccugcccuuccagaacauccaccccaucaccaucgggaagugcccgaaguacgucaagagcacgaagcugcggcucgccaccggccugcgcaacgugcccuccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgcggccuccagccugguccucguggugucccugggggccaucucguucuggaugugcagcaacggcucccugcagugccggaucugcaucuga

SEQ ID NO: 12213 - RNA, 1701 nt, Artificial Sequence; identical to SEQ ID NO: 10285
  derived and/or modified CDS sequence (AUadapt) from InfluenzaA__AHV83846__HA

SEQ ID NO: 12214 - RNA, 1701 nt, Artificial Sequence; identical to SEQ ID NO: 10285
  derived and/or modified CDS sequence (AUadapt) from InfluenzaA__AHV83847__HA

SEQ ID NO: 12215 - RNA, 1701 nt, Artificial Sequence; identical to SEQ ID NO: 10285
  derived and/or modified CDS sequence (AUadapt) from InfluenzaA__AHV83848__HA

SEQ ID NO: 12216 - RNA, 1701 nt, Artificial Sequence; identical to SEQ ID NO: 12138
  derived and/or modified CDS sequence (AUadapt) from InfluenzaA__AHV83849__HA

SEQ ID NO: 12217 - RNA, 1701 nt, Artificial Sequence
  derived and/or modified CDS sequence (AUadapt) from InfluenzaA__AHV83850__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaaggccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcaccacggcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12218 - RNA, 1701 nt, Artificial Sequence; identical to SEQ ID NO: 10285
  derived and/or modified CDS sequence (AUadapt) from InfluenzaA__AHV83851__HA

SEQ ID NO: 12219 - RNA, 1701 nt, Artificial Sequence; identical to SEQ ID NO: 10285
  derived and/or modified CDS sequence (AUadapt) from InfluenzaA__AHV83852__HA

SEQ ID NO: 12220 - RNA, 1701 nt, Artificial Sequence
  derived and/or modified CDS sequence (AUadapt) from InfluenzaA__AHV83853__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagacccugucgaccgccuccucgugguccuacaucguggagacgagcuccucggacaacgggaccugcuaccccggcgacuucaucgacuacgaggagcuccgggagcagcuguccucgguguccagcuucgagcgcuucgagaucuuccccaagaccuccucguggcccaaccacgacuccaacaagggcgucaccgccgccugcccgcacgccggcgcgaagggguucuacaagaaccugaucuggcucgugaagaagggcaacucguaccccaagcuguccaagagcuacaucaacgacaaggggaaggaggugcugguccucuggggcauccaccaccccuccacgaccgccgaccagcagucgcuguaccagaacgccgacaccuacguguucgugggcaccucgcgguacuccaagaaguucaagcccgagaucgccauccgcccgaagguccgggaccaggaggggcgcaugaacuacuacuggacgcugguggagcccggcgacaagaucaccuucgaggccaccgggaaccucguggucccccgguacgcguucgccauggagcgcgacgccggcucgggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgccaccgggcugcgcaacgucccgucgauccagucccggggccuguucggggcgaucgccggcuucaucgagggcggguggaccggcaugguggacgggugguacggcuaccaccaccagaacgagcaggggucgggcuacgccgccgaccucaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcacccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggaggagaucgacggggugaagcucgagucgacccgcaucuaccagauccuggccaucuacuccaccgcggccagcucccugguccucguggugucgcugggcgccaucuccuucuggaugugcucgaacggcagccugcagugccggaucugcaucuga

SEQ ID NO: 12221 - RNA, 1701 nt, Artificial Sequence; identical to SEQ ID NO: 12147
  derived and/or modified CDS sequence (AUadapt) from InfluenzaA__AHV83855__HA

SEQ ID NO: 12222 - RNA, 1701 nt, Artificial Sequence
  derived and/or modified CDS sequence (AUadapt) from InfluenzaA__AHV83856__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagaucgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 12223 - RNA, 1701 nt, Artificial Sequence; identical to SEQ ID NO: 12147
  derived and/or modified CDS sequence (AUadapt) from InfluenzaA__AHV83857__HA

SEQ ID NO: 12224 - RNA, 1701 nt, Artificial Sequence
  derived and/or modified CDS sequence (AUadapt) from InfluenzaA__AHV83858__HA
augaaggccauccuggugguccuccuguacaccuucgccaccgcgaacacggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcucgggguacgccgccgaccagaaguccacgcagaacgccaucgacaagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgccaucuacuccaccgucgccucgucccuggugcugguggucagccucggggcgaucucguucuggaugugcuccaacggcagccugcagugccggaucugcaucuga

SEQ ID NO: 12225 - RNA, 1701 nt, Artificial Sequence; identical to SEQ ID NO: 10285
  derived and/or modified CDS sequence (AUadapt) from InfluenzaA__AHV83859__HA

SEQ ID NO: 12226 - RNA, 1701 nt, Artificial Sequence
  derived and/or modified CDS sequence (AUadapt) from InfluenzaA__AHV83861__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12227 - RNA, 1701 nt, Artificial Sequence; identical to SEQ ID NO: 12226
  derived and/or modified CDS sequence (AUadapt) from InfluenzaA__AHV83862__HA

SEQ ID NO: 12228 - RNA, 1701 nt, Artificial Sequence; identical to SEQ ID NO: 10285
  derived and/or modified CDS sequence (AUadapt) from InfluenzaA__AHV83863__HA

SEQ ID NO: 12229 - RNA, 1701 nt, Artificial Sequence; identical to SEQ ID NO: 10285
  derived and/or modified CDS sequence (AUadapt) from InfluenzaA__AHV83864__HA

SEQ ID NO: 12230 - RNA, 1701 nt, Artificial Sequence
  derived and/or modified CDS sequence (AUadapt) from InfluenzaA__AHV83866__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccauccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacgacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12231 - RNA, 1701 nt, Artificial Sequence
  derived and/or modified CDS sequence (AUadapt) from InfluenzaA__AHV83867__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacgacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12232 - RNA, 1701 nt, Artificial Sequence; identical to SEQ ID NO: 10285
  derived and/or modified CDS sequence (AUadapt) from InfluenzaA__AHV83868__HA

SEQ ID NO: 12233 - RNA, 1701 nt, Artificial Sequence
  derived and/or modified CDS sequence (AUadapt) from InfluenzaA__AHV83869__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccaacagcuggcccaaccacgacuccaacaagggggucaccgccgccugcccgcacgccggcgccaagucguucuacaagaaccugaucuggcucgugaagaaggggaacuccuaccccaagcugucgcaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 12234 - RNA, 1701 nt, Artificial Sequence; identical to SEQ ID NO: 10285
  derived and/or modified CDS sequence (AUadapt) from InfluenzaA__AHV83870__HA

SEQ ID NO: 12235 - RNA, 1701 nt, Artificial Sequence; identical to SEQ ID NO: 10285
  derived and/or modified CDS sequence (AUadapt) from InfluenzaA__AHV83871__HA

SEQ ID NO: 12236 - RNA, 1701 nt, Artificial Sequence; identical to SEQ ID NO: 10285
  derived and/or modified CDS sequence (AUadapt) from InfluenzaA__AHV83872__HA

SEQ ID NO: 12237 - RNA, 1701 nt, Artificial Sequence
  derived and/or modified CDS sequence (AUadapt) from InfluenzaA__AHV83873__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgguggcggaccagcagucccuguaccagaacgccgacgccuacguguucgucggcaccucgcgguacuccaagaaguucaagcccgagaucgccauccgcccgaaggugcgggaccaggagggccgcaugaacuacuacuggacccugguggagcccggggacaagaucaccuucgaggccacgggcaaccucgucgugccccgguacgcguucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgucaaguccacgaagcugcggcucgccaccggccugcgcaacgugccgagcauccagucccgggggcuguucggcgccaucgcgggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggccucgucccuggugcucgucgugagccugggggcgaucucguucuggaugugcuccaacggcagccugcagugccggaucugcaucuga

SEQ ID NO: 12238 - RNA, 1701 nt, Artificial Sequence; identical to SEQ ID NO: 10285
  derived and/or modified CDS sequence (AUadapt) from InfluenzaA__AHV83874__HA

SEQ ID NO: 12239 - RNA, 1701 nt, Artificial Sequence; identical to SEQ ID NO: 10285
  derived and/or modified CDS sequence (AUadapt) from InfluenzaA__AHV83875__HA

SEQ ID NO: 12240 - RNA, 1701 nt, Artificial Sequence; identical to SEQ ID NO: 10285
  derived and/or modified CDS sequence (AUadapt) from InfluenzaA__AHV83876__HA

SEQ ID NO: 12241 - RNA, 1701 nt, Artificial Sequence
  derived and/or modified CDS sequence (AUadapt) from InfluenzaA__AHV83877__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucaagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12242 - RNA, 1701 nt, Artificial Sequence; identical to SEQ ID NO: 12152
  derived and/or modified CDS sequence (AUadapt) from InfluenzaA__AHV83878__HA

SEQ ID NO: 12243 - RNA, 1701 nt, Artificial Sequence; identical to SEQ ID NO: 12152
  derived and/or modified CDS sequence (AUadapt) from InfluenzaA__AHV83879__HA

SEQ ID NO: 12244 - RNA, 1701 nt, Artificial Sequence
  derived and/or modified CDS sequence (AUadapt) from InfluenzaA__AHV83881__HA
augaaggccacccuggugguccuccuguacaccuucgccacggcgaacgccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgacgaccgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacgcagaacgccaucgacaagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12245 - RNA, 1701 nt, Artificial Sequence; identical to SEQ ID NO: 11266
  derived and/or modified CDS sequence (AUadapt) from InfluenzaA__AHV83882__HA

SEQ ID NO: 12246 - RNA, 1701 nt, Artificial Sequence; identical to SEQ ID NO: 11248
  derived and/or modified CDS sequence (AUadapt) from InfluenzaA__AHV83883__HA

SEQ ID NO: 12247 - RNA, 1701 nt, Artificial Sequence; identical to SEQ ID NO: 10285
  derived and/or modified CDS sequence (AUadapt) from InfluenzaA__AHV83884__HA

SEQ ID NO: 12248 - RNA, 1701 nt, Artificial Sequence
  derived and/or modified CDS sequence (AUadapt) from InfluenzaA__AHV83885__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccguguacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12249 - RNA, 1701 nt, Artificial Sequence; identical to SEQ ID NO: 12165
  derived and/or modified CDS sequence (AUadapt) from InfluenzaA__AHV83887__HA

SEQ ID NO: 12250 - RNA, 1701 nt, Artificial Sequence; identical to SEQ ID NO: 10285
  derived and/or modified CDS sequence (AUadapt) from InfluenzaA__AHV83888__HA

SEQ ID NO: 12251 - RNA, 1701 nt, Artificial Sequence
  derived and/or modified CDS sequence (AUadapt) from InfluenzaA__AHV83889__HA
augaaggccauccuggugguccuccugcacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccucguccuggcccaaccacgacagcaacaagggggucaccgccgccugcccgcacgccggcgcgaaguccuucuacaagaaccucaucuggcuggugaagaaggggaacucguaccccaagcugucccagucguacaucaacgacaagggcaaggaggugcucguccugugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcuccggcuggccaccggccugcgcaacgucccgucgauccagucccggggccucuucggggcgaucgccggguucaucgagggcggcuggaccgggaugguggacggcugguacggguaccaccaccagaacgagcagggcucgggguacgccgccgaccugaaguccacccagaacgccaucgacaagaucacgaacaaggugaacagcgucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggagaagaucgacggcgugaagcuggagucgacccgcaucuaccagauccuggccaucuacuccaccgucgcgagcucccucgugcugguggucucgcugggggccaucucguucuggaugugcuccaacggcagccuccagugccggaucugcaucuga

SEQ ID NO: 12252 - RNA, 1701 nt, Artificial Sequence; identical to SEQ ID NO: 10285
  derived and/or modified CDS sequence (AUadapt) from InfluenzaA__AHV83890__HA

SEQ ID NO: 12253 - RNA, 1701 nt, Artificial Sequence; identical to SEQ ID NO: 10285
  derived and/or modified CDS sequence (AUadapt) from InfluenzaA__AHV83891__HA

SEQ ID NO: 12254 - RNA, 1701 nt, Artificial Sequence; identical to SEQ ID NO: 10285
  derived and/or modified CDS sequence (AUadapt) from InfluenzaA__AHV83893__HA

SEQ ID NO: 12255 - RNA, 1701 nt, Artificial Sequence; identical to SEQ ID NO: 10285
  derived and/or modified CDS sequence (AUadapt) from InfluenzaA__AHV83894__HA

SEQ ID NO: 12256 - RNA, 1701 nt, Artificial Sequence
  derived and/or modified CDS sequence (AUadapt) from InfluenzaA__AHV83895__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggagaccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12257 - RNA, 1701 nt, Artificial Sequence; identical to SEQ ID NO: 10285
  derived and/or modified CDS sequence (AUadapt) from InfluenzaA__AHV83896__HA

SEQ ID NO: 12258 - RNA, 1701 nt, Artificial Sequence; identical to SEQ ID NO: 10285
  derived and/or modified CDS sequence (AUadapt) from InfluenzaA__AHV83897__HA

SEQ ID NO: 12259 - RNA, 1701 nt, Artificial Sequence
  derived and/or modified CDS sequence (AUadapt) from InfluenzaA__AHV83898__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgucaccggccugcgcaacgugccgagcauccagucccgggggcuguucggcgccaucgcgggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggccucgucccuggugcucgucgugagccugggggcgaucucguucuggaugugcuccaacggcagccugcagugccggaucugcaucuga

SEQ ID NO: 12260 - RNA, 1701 nt, Artificial Sequence; identical to SEQ ID NO: 10285
  derived and/or modified CDS sequence (AUadapt) from InfluenzaA__AHV83899__HA

SEQ ID NO: 12261 - RNA, 1701 nt, Artificial Sequence; identical to SEQ ID NO: 10285
  derived and/or modified CDS sequence (AUadapt) from InfluenzaA__AHV83900__HA

SEQ ID NO: 12262 - RNA, 1701 nt, Artificial Sequence; identical to SEQ ID NO: 10285
  derived and/or modified CDS sequence (AUadapt) from InfluenzaA__AHV83901__HA

SEQ ID NO: 12263 - RNA, 1701 nt, Artificial Sequence; identical to SEQ ID NO: 10285
  derived and/or modified CDS sequence (AUadapt) from InfluenzaA__AHV83902__HA

SEQ ID NO: 12264 - RNA, 1701 nt, Artificial Sequence; identical to SEQ ID NO: 10285
  derived and/or modified CDS sequence (AUadapt) from InfluenzaA__AHV83903__HA

SEQ ID NO: 12265 - RNA, 1701 nt, Artificial Sequence; identical to SEQ ID NO: 10285
  derived and/or modified CDS sequence (AUadapt) from InfluenzaA__AHV83904__HA

SEQ ID NO: 12266 - RNA, 1701 nt, Artificial Sequence
  derived and/or modified CDS sequence (AUadapt) from InfluenzaA__AHV83905__HA
augaaggccauccuggugguccuccuguacacccugaccacggccaacgcggacacccucugcaucggcuaccacgccaacaacucgaccgacaccguggacacggugcuggagaagaacgucaccgugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagacguccucguccgacaacgggaccugcuaccccggcgacuucaucaacuacgaggagcugcgggagcagcugagcuccgugucguccuucgagcgcuucgagaucuuccccaagaccagcuccuggcccaaccacgacucgaacaagggggucaccgccgccugcccgcacgccggcgccaaguccuucuacaagaaccucaucuggcuggugaagaaggggaacucguaccccaagcugucccagagcuacaucaacgacaagggcaaggaggugcucguccugugggggauccaccaccccucgacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucacguucgaggccaccggcaaccugguggucccccgguacgcguucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcuccggcuggccaccggccugcgcaacgucccgagcauccagucccggggccucuucggcgccaucgcgggguucaucgagggcggcuggaccgggaugguggacggcugguacggguaccaccaccagaacgagcagggcucgggguacgccgccgaccugaaguccacgcagaacgccaucgacaagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagucgacccgcaucuaccagauccuggccaucuacuccaccgucgccucgucccucgugcugguggucagccugggggcgaucucguucuggaugugcuccaacggcagccuccagugccggaucugcaucuga

SEQ ID NO: 12267 - RNA, 1701 nt, Artificial Sequence; identical to SEQ ID NO: 10285
  derived and/or modified CDS sequence (AUadapt) from InfluenzaA__AHV83906__HA

SEQ ID NO: 12268 - RNA, 1701 nt, Artificial Sequence; identical to SEQ ID NO: 10285
  derived and/or modified CDS sequence (AUadapt) from InfluenzaA__AHV83907__HA

SEQ ID NO: 12269 - RNA, 1701 nt, Artificial Sequence
  derived and/or modified CDS sequence (AUadapt) from InfluenzaA__AHV83908__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugucgaccgcguccagcugguccuacaucguggagaccucguccucggacaacggcacgugcuaccccggcgacuucaucaacuacgaggagcuccgggagcagcuguccagcguguccucguucgagcgcuucgagaucuuccccaagaccuccagcuggccgaaccacgacuccaacaagggggucaccgccgccugcccccacgccggcgccaagucguucuacaagaaccugaucuggcucgugaagaaggggaacuccuaccccaagcugucgcaguccuacaucaacgacaagggcaagaaggugcugguccucugggggauccaccaccccagcaccacggccgaccagcagucgcuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacaccccggugcacgacugcaacaccacgugccagacccccgagggcgccaucaacaccucccugcccuuccagaacauccaccccaucaccaucgggaagugcccgaaguacgucaagucgacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 12270 - RNA, 1701 nt, Artificial Sequence
  derived and/or modified CDS sequence (AUadapt) from InfluenzaA__AHV83911__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugucgaccgcguccagcugguccuacaucguggagaccucguccucggacaacggcacgugcuaccccggcgacuucaucaacuacgaggagcuccgggagcagcuguccagcguguccucguucgagcgcuucgagaucuuccccaagaccuccagcuggccgaaccacgacuccaacaagggggucaccgccgccugcccccacgccggcgccaagucguucuacaagaaccugaucuggcucgugaagaaggggaacuccuaccccaagcugucgcaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacaccccggugcacgacugcaacaccacgugccagacccccgagggcgccaucaacaccucccugcccuuccagaacauccaccccaucaccaucgggaagugcccgaaguacgucaagucgacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 12271 - RNA, 1701 nt, Artificial Sequence; identical to SEQ ID NO: 10285
  derived and/or modified CDS sequence (AUadapt) from InfluenzaA__AHV83912__HA

SEQ ID NO: 12272 - RNA, 1701 nt, Artificial Sequence; identical to SEQ ID NO: 10285
  derived and/or modified CDS sequence (AUadapt) from InfluenzaA__AHV83913__HA

SEQ ID NO: 12273 - RNA, 1701 nt, Artificial Sequence; identical to SEQ ID NO: 10285
  derived and/or modified CDS sequence (AUadapt) from InfluenzaA__AHV83915__HA

SEQ ID NO: 12274 - RNA, 1701 nt, Artificial Sequence; identical to SEQ ID NO: 10285
  derived and/or modified CDS sequence (AUadapt) from InfluenzaA__AHV83916__HA

SEQ ID NO: 12275 - RNA, 1701 nt, Artificial Sequence; identical to SEQ ID NO: 12270
  derived and/or modified CDS sequence (AUadapt) from InfluenzaA__AHV83917__HA

SEQ ID NO: 12276 - RNA, 1701 nt, Artificial Sequence; identical to SEQ ID NO: 11248
  derived and/or modified CDS sequence (AUadapt) from InfluenzaA__AHV83919__HA

SEQ ID NO: 12277 - RNA, 1701 nt, Artificial Sequence; identical to SEQ ID NO: 12165
  derived and/or modified CDS sequence (AUadapt) from InfluenzaA__AHV83920__HA

SEQ ID NO: 12278 - RNA, 1701 nt, Artificial Sequence; identical to SEQ ID NO: 11266
  derived and/or modified CDS sequence (AUadapt) from InfluenzaA__AHV83921__HA

SEQ ID NO: 12279 - RNA, 1701 nt, Artificial Sequence
  derived and/or modified CDS sequence (AUadapt) from InfluenzaA__AHV83922__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucucccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 12280 - RNA, 1701 nt, Artificial Sequence; identical to SEQ ID NO: 12181
  derived and/or modified CDS sequence (AUadapt) from InfluenzaA__AHV83923__HA

SEQ ID NO: 12281 - RNA, 1701 nt, Artificial Sequence; identical to SEQ ID NO: 12165
  derived and/or modified CDS sequence (AUadapt) from InfluenzaA__AHV83924__HA

SEQ ID NO: 12282 - RNA, 1701 nt, Artificial Sequence; identical to SEQ ID NO: 12181
  derived and/or modified CDS sequence (AUadapt) from InfluenzaA__AHV83925__HA

SEQ ID NO: 12283 - RNA, 1701 nt, Artificial Sequence; identical to SEQ ID NO: 12165
  derived and/or modified CDS sequence (AUadapt) from InfluenzaA__AHV83926__HA

SEQ ID NO: 12284 - RNA, 1701 nt, Artificial Sequence; identical to SEQ ID NO: 12270
  derived and/or modified CDS sequence (AUadapt) from InfluenzaA__AHV83927__HA

SEQ ID NO: 12285 - RNA, 1701 nt, Artificial Sequence
  derived and/or modified CDS sequence (AUadapt) from InfluenzaA__AHV83928__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcucgggguacgccgccgaccagaaguccacgcagaacgccaucgacaagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgccaucuacuccaccgucgccucgucccuggugcugguggucagccucggggcgaucucguucuggaugugcuccaacggcagccugcagugccggaucugcaucuga

SEQ ID NO: 12286 - RNA, 1701 nt, Artificial Sequence; identical to SEQ ID NO: 12165
  derived and/or modified CDS sequence (AUadapt) from InfluenzaA__AHV83929__HA

SEQ ID NO: 12287 - RNA, 1701 nt, Artificial Sequence
  derived and/or modified CDS sequence (AUadapt) from InfluenzaA__AHV83930__HA
augaaggccauccuggugauccuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcugucccagucguacaucaacgacaagggcaaggaggugcuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12288 - RNA, 1701 nt, Artificial Sequence; identical to SEQ ID NO: 12165
  derived and/or modified CDS sequence (AUadapt) from InfluenzaA__AHV83931__HA

SEQ ID NO: 12289 - RNA, 1701 nt, Artificial Sequence; identical to SEQ ID NO: 10285
  derived and/or modified CDS sequence (AUadapt) from InfluenzaA__AHV83932__HA

SEQ ID NO: 12290 - RNA, 1701 nt, Artificial Sequence
  derived and/or modified CDS sequence (AUadapt) from InfluenzaA__AHV83933__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgcggccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgccaucgcgggguucaucgagggcggcuggaccgggaugguggacggcugguacggguaccaccaccagaacgagcagggcucgggguacgccgccgaccagaaguccacgcagaacgccaucgacaagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgcggagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgcccuguacuccaccgucgccucgucccuggugcucguggucagccugggggcgaucucguucuggaugugcuccaacggcagccugcagugccggaucugcaucuga

SEQ ID NO: 12291 - RNA, 1701 nt, Artificial Sequence; identical to SEQ ID NO: 11248
  derived and/or modified CDS sequence (AUadapt) from InfluenzaA__AHV83934__HA

SEQ ID NO: 12292 - RNA, 1701 nt, Artificial Sequence; identical to SEQ ID NO: 10285
  derived and/or modified CDS sequence (AUadapt) from InfluenzaA__AHV83935__HA

SEQ ID NO: 12293 - RNA, 1701 nt, Artificial Sequence; identical to SEQ ID NO: 10285
  derived and/or modified CDS sequence (AUadapt) from InfluenzaA__AHV83937__HA

SEQ ID NO: 12294 - RNA, 1701 nt, Artificial Sequence
  derived and/or modified CDS sequence (AUadapt) from InfluenzaA__AHV83938__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagaucucccagagcuacaucaacgacaagggcaaggaggugcugguccugugggggauccaccaccccucgaccacggccgaccagcagucccucuaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacgccgggagcggcaucaucaucuccgacacccccgugcacgacugcaacaccacgugccagaccccggagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggguucaucgagggcggcuggaccgggaugguggacggcugguacggguaccaccaccagaacgagcagggcucgggguacgccgccgaccagaaguccacccagaacgccaucgacaagaucacgaacaaggugaacucggucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagucgacccgcaucuaccagauccuggccaucuacuccaccgucgcgucgucccucgugcugguggucagccugggggccaucucguucuggaugugcuccaacggcagccuccagugccggaucugcaucuga

SEQ ID NO: 12295 - RNA, 1701 nt, Artificial Sequence; identical to SEQ ID NO: 12294
  derived and/or modified CDS sequence (AUadapt) from InfluenzaA__AHV83939__HA

SEQ ID NO: 12296 - RNA, 1701 nt, Artificial Sequence
  derived and/or modified CDS sequence (AUadapt) from InfluenzaA__AHV83940__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccagaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuucauggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgaccgcgugaagcuggagucgacccggaucuaccagauccuggccaucuacuccaccgucgcgucgucccucgugcugguggucagccugggcgccaucucguucuggaugugcuccaacgggagccuccagugccgcaucugcaucuga

SEQ ID NO: 12297 - RNA, 1701 nt, Artificial Sequence; identical to SEQ ID NO: 10285
  derived and/or modified CDS sequence (AUadapt) from InfluenzaA__AHV83941__HA

SEQ ID NO: 12298 - RNA, 1701 nt, Artificial Sequence
  derived and/or modified CDS sequence (AUadapt) from InfluenzaA__AHV83943__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacaugugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12299 - RNA, 1701 nt, Artificial Sequence
  derived and/or modified CDS sequence (AUadapt) from InfluenzaA__AHV83944__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacgagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12300 - RNA, 1701 nt, Artificial Sequence
  derived and/or modified CDS sequence (AUadapt) from InfluenzaA__AHV83945__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacgaccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12301 - RNA, 1701 nt, Artificial Sequence
  derived and/or modified CDS sequence (AUadapt) from InfluenzaA__AHV83947__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccgugaagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgucaaguccacgaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcucgggguacgccgccgaccagaaguccacccagaacgccaucgacaagaucacgaacaaggucaacucggugaucgagaagaugaacacccaguucaccgcggucggcaaggaguucaaccaccucgagaagcgcaucgagaaccugaacaagaagguggacgacggcuuccuggacaucuggaccuacaacgccgagcuccuggugcugcucgagaacgagcggacgcuggacuaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgucaagcuggagucgacccgcaucuaccagauccucgccaucuacuccaccguggcgucgucccuggugcuggucgugagccucggggccaucucguucuggaugugcuccaacggcagccugcagugccggaucugcaucuga

SEQ ID NO: 12302 - RNA, 1701 nt, Artificial Sequence; identical to SEQ ID NO: 10285
  derived and/or modified CDS sequence (AUadapt) from InfluenzaA__AHV83948__HA

SEQ ID NO: 12303 - RNA, 1701 nt, Artificial Sequence; identical to SEQ ID NO: 10285
  derived and/or modified CDS sequence (AUadapt) from InfluenzaA__AHV83949__HA

SEQ ID NO: 12304 - RNA, 1701 nt, Artificial Sequence; identical to SEQ ID NO: 10285
  derived and/or modified CDS sequence (AUadapt) from InfluenzaA__AHV83950__HA

SEQ ID NO: 12305 - RNA, 1701 nt, Artificial Sequence
  derived and/or modified CDS sequence (AUadapt) from InfluenzaA__AHV83953__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggaccucggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcugugcgucgcccuccugggguucaucaugugggcgugccagaagggcaacauccggugcaacaucugcaucuga

SEQ ID NO: 12306 - RNA, 1701 nt, Artificial Sequence; identical to SEQ ID NO: 12137
  derived and/or modified CDS sequence (AUadapt) from InfluenzaA__AHV83954__HA

SEQ ID NO: 12307 - RNA, 1701 nt, Artificial Sequence
  derived and/or modified CDS sequence (AUadapt) from InfluenzaA__AHV83956__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgagaacuucaacugggccggggugacgcagaacggcaccuccagcgccugcauccggggguccaacucguccuucuucagccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccucgggccggaucaccguguccaccaagcgcagccagcaggccgugaucccgaacaucggcucgcggccccgcauccggaacauccccucccgcaucagcaucuacuggaccaucgucaagcccggggacauccugcucaucaacuccacgggcaaccugaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcagagcacccugaagcucgccacggggaugcgcaacguccaggagaagcagacccggggcaucuucggggccaucgccggcuucaucgagaacggcugggaggggaugaaggacggcugguacggguuccgccaccagaacuccgagggccgggggcaggccgcggaccucaagucgacccaggccgccaucgaccagaucaacggcaagcugaaccgccugaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcucgauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggcgugccagaagggcaacauccggugcaacaucugcaucuga

SEQ ID NO: 12308 - RNA, 1701 nt, Artificial Sequence
  derived and/or modified CDS sequence (AUadapt) from InfluenzaA__AHZ13523__HA
augaagaccaucaucgcccugucguacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacucgccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccucguccggcacgcuggaguucaucaacgagggguucaacuggaccggcgugacccagagcgggggcuccuacgccugcaagcgcgggagcgugaacuccuucuucucgcggcugaacuggcucuacaaguccgagagcaaguaccccguccugaacgugaccaugcccaacaacggcaaguucgacaagcuguacaucuggggcgugcaccaccccuccacggacaaggagcagaccaaccucuacguccgcgccagcgggcgggugaccgugucgaccaagcgcucccagcagacggucaucccgaacaucggcagccggcccugggugcgcgggcuguccagccggaucuccaucuacuggaccaucgugaagcccggcgacauccugcucaucaacucgaccggcaaccugaucgcgccccgcggguacuucaagauccggaccggcaaguccagcaucaugcgcuccgacgccccgaucgggacgugcagcuacgagugcaucacccccaacggcuccauccccaacgacaagcccuuccagaacgucaacaagaucaccuacggggccugcccgcgguacgugaagcagaacacccugaagcucgccacgggcaugcgcaacgugcccgagaagcagacccggggcaucuucggggccaucgcgggcuucaucgagaacgggugggagggcauggucgacgggugguacggcuuccgccaccagaacucggagggcaccgggcaggccgccgaccugaaguccacccaggccgccaucgaccagaucaacggcaagcugaaccggcucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacaaccacgacguguaccgggacgaggcccucaacaaccgcuuccagaucaagggggucgagcugaaguccggcuacaaggacuggauccuguggaucuccuucgcgaucagcugcuuccuccugugcguggugcugcucggguucaucaugugggccugccagaagggcaacauccggugcaacaucugcaucuga

SEQ ID NO: 12309 - RNA, 1698 nt, Artificial Sequence; identical to SEQ ID NO: 3861
  derived and/or modified CDS sequence (AUadapt) from InfluenzaA__AHZ13582__HA

SEQ ID NO: 12310 - RNA, 1701 nt, Artificial Sequence
  derived and/or modified CDS sequence (AUadapt) from InfluenzaA__AHZ35584__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcagccagcaggccgugaucccgaacaucgggucgcggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacucggagggccgggggcaggcggccgaccucaaguccacgcaggccgccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 12311 - RNA, 1701 nt, Artificial Sequence
  derived and/or modified CDS sequence (AUadapt) from InfluenzaA__AHZ35608__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaaggagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcagccagcaggccgugaucccgaacaucgggucgcggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacagcgcgugcaucacccccaacggcuccauccccaacgacaagccguuccagaacgugaaccgcaucacguacgggaccugcccccgguacgucaagcagaacacccugaagcuggccaccggcaugcgcaacgugcccgagaagcagacgcggggcaucuucggggccaucgccggcuucaucgagaacgggugggagggcaugguggacggcugguacggguuccgccaccagaacucggagggccgggggcaggccgcggaccucaaguccacccaggccgccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcucugcguggcccugcugggcuucaucaugugggcgugccagaagggcaacauccggugcaacaucugcaucuga

SEQ ID NO: 12312 - RNA, 1701 nt, Artificial Sequence; identical to SEQ ID NO: 12310
  derived and/or modified CDS sequence (AUadapt) from InfluenzaA__AHZ35620__HA

SEQ ID NO: 12313 - RNA, 1701 nt, Artificial Sequence; identical to SEQ ID NO: 12310
  derived and/or modified CDS sequence (AUadapt) from InfluenzaA__AHZ35632__HA

SEQ ID NO: 12314 - RNA, 1701 nt, Artificial Sequence; identical to SEQ ID NO: 12310
  derived and/or modified CDS sequence (AUadapt) from InfluenzaA__AHZ35644__HA

SEQ ID NO: 12315 - RNA, 1701 nt, Artificial Sequence; identical to SEQ ID NO: 12310
  derived and/or modified CDS sequence (AUadapt) from InfluenzaA__AHZ35656__HA

SEQ ID NO: 12316 - RNA, 1701 nt, Artificial Sequence; identical to SEQ ID NO: 12310
  derived and/or modified CDS sequence (AUadapt) from InfluenzaA__AHZ35668__HA

SEQ ID NO: 12317 - RNA, 1701 nt, Artificial Sequence; identical to SEQ ID NO: 12311
  derived and/or modified CDS sequence (AUadapt) from InfluenzaA__AHZ35680__HA

SEQ ID NO: 12318 - RNA, 1701 nt, Artificial Sequence; identical to SEQ ID NO: 12310
  derived and/or modified CDS sequence (AUadapt) from InfluenzaA__AHZ35692__HA

SEQ ID NO: 12319 - RNA, 1701 nt, Artificial Sequence; identical to SEQ ID NO: 12310
  derived and/or modified CDS sequence (AUadapt) from InfluenzaA__AHZ35716__HA

SEQ ID NO: 12320 - RNA, 1701 nt, Artificial Sequence; identical to SEQ ID NO: 12311
  derived and/or modified CDS sequence (AUadapt) from InfluenzaA__AHZ35728__HA

SEQ ID NO: 12321 - RNA, 1701 nt, Artificial Sequence; identical to SEQ ID NO: 12310
  derived and/or modified CDS sequence (AUadapt) from InfluenzaA__AHZ35740__HA

SEQ ID NO: 12322 - RNA, 1701 nt, Artificial Sequence; identical to SEQ ID NO: 12310
  derived and/or modified CDS sequence (AUadapt) from InfluenzaA__AHZ35752__HA

SEQ ID NO: 12323 - RNA, 1701 nt, Artificial Sequence; identical to SEQ ID NO: 12310
  derived and/or modified CDS sequence (AUadapt) from InfluenzaA__AHZ35764__HA

SEQ ID NO: 12324 - RNA, 1701 nt, Artificial Sequence; identical to SEQ ID NO: 12310
  derived and/or modified CDS sequence (AUadapt) from InfluenzaA__AHZ35776__HA

SEQ ID NO: 12325 - RNA, 1701 nt, Artificial Sequence
  derived and/or modified CDS sequence (AUadapt) from InfluenzaA__AHZ35823__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgcuucgagauguuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12326 - RNA, 1701 nt, Artificial Sequence; identical to SEQ ID NO: 12325
  derived and/or modified CDS sequence (AUadapt) from InfluenzaA__AHZ35834__HA

SEQ ID NO: 12327 - RNA, 1701 nt, Artificial Sequence; identical to SEQ ID NO: 12325
  derived and/or modified CDS sequence (AUadapt) from InfluenzaA__AHZ35845__HA

SEQ ID NO: 12328 - RNA, 1701 nt, Artificial Sequence; identical to SEQ ID NO: 12325
  derived and/or modified CDS sequence (AUadapt) from InfluenzaA__AHZ35856__HA

SEQ ID NO: 12329 - RNA, 1701 nt, Artificial Sequence
  derived and/or modified CDS sequence (AUadapt) from InfluenzaA__AHZ35867__HA
augaagaccaacaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccucguccaccggggagaucugcaacagcccccaccagauccucgacggcgagaacugcacccugaucgacgcccugcucggggacccccagugcgacggcuuccagaacaagaagugggaccuguucguggagcgcuccaaggcccacucgaacugcuaccccuacgacgugccggacuacgcgucccugcggucgcucgucgccuccagcggcacgcuggaguucaacaacgaguccuucaacuggaccggggugacccagaacggcaccucguccgccugcauccgccggucgaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccguguccacgaagcgcagccagcaggccgugaucccgaacaucggcucgcggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcgcccaucggcaagugcaacucggccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacucggaggggcggggccaggccgccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgcggagcuccuggucgugcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcucaagucgggcuacaaggacuggauccuguggaucuccuucgccaucagcugcuuccugcugugcguggcgcugcucggcuucaucaugugggccugccagaaggggaacauccggugcaacaucugcaucuga

SEQ ID NO: 12330 - RNA, 1701 nt, Artificial Sequence
  derived and/or modified CDS sequence (AUadapt) from InfluenzaA__AHZ35879__HA
augaagaccaacaucgcccugucguacauccucugccugguguccgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccucguccaccggggagaucugcaacucgccccaccagauccucgacggcgagaacugcacccugaucgacgcccugcucggggacccccagugcgacggcuuccagaacaagaagugggaccuguucguggagcgcuccaaggcccacagcaacugcuaccccuacgacgugccggacuacgcgucccugcggucgcucgucgccuccucgggcacgcuggaguucaacaacgaguccuucaacuggaccggggugacccagaacggcaccucguccgccugcauccgccggagcaacaacuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccgccgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcgcccaucggcaagugcaacucggccugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgcgggguucaucgagaacggcugggagggcauggucgacgggugguacggcuuccgccaccagaacagcgaggggcggggccaggccgccgaccugaaguccacgcaggccgccaucgaccagaucaacgggaagcugaaccgccucaucggcaagaccaacgagaaguuccaccagaucgagaaggaguucucggagguggagggccggauccaggaccuggagaaguacguggaggacaccaagaucgaccugugguccuacaacgcggagcuccuggucgcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcucaagucgggcuacaaggacuggauccuguggaucuccuucgcgaucagcugcuuccugcugugcgucgcccugcucggcuucaucaugugggccugccagaaggggaacauccggugcaacaucugcaucuga

SEQ ID NO: 12331 - RNA, 1701 nt, Artificial Sequence; identical to SEQ ID NO: 12325
  derived and/or modified CDS sequence (AUadapt) from InfluenzaA__AHZ35891__HA

SEQ ID NO: 12332 - RNA, 1701 nt, Artificial Sequence; identical to SEQ ID NO: 12325
  derived and/or modified CDS sequence (AUadapt) from InfluenzaA__AHZ35902__HA

SEQ ID NO: 12333 - RNA, 1710 nt, Artificial Sequence
  derived and/or modified CDS sequence (AUadapt) from InfluenzaA__AHZ35913__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacgggaccugcuaccccggcgacuucaucaacuacgaggagcuccgggagcagcugagcuccgugucguccuucgagcgcuucgagauguuccccaagacgagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccaccgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggucgggcaucaucaucuccgacacgcccgugcacgacugcaacacgaccugccagaccccgaagggcgccaucaacaccagccugaccucccugcccuuccagaacauccaccccaucaccaucgggaagugccccaaguacgucaagucgaccaagcuccggcuggcgacgggccugcgcaacgugccguccauccagagccggggccucuucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcugcucgugcugcuggagaacgagcggacccucgacuaccacgacagcaacgugaagaaccuguacgagcgcguccggaaccagcugaagaacaacgccaaggagaucgggaacggcugcuucgaguucuaccacaagugcgacaacacgugcauggaguccgugaagaacgggaccuacgacuaccccaaguacucggaggaggccaagcucaaccgcgaggagaucgacggcgugaagcuggaguccacccggaucuaccagauccuggcgaucuacagcaccgucgccuccucgcucgugcugguggucagccugggggccaucuccuucuggaugugcagcaacggcucccuccagugccgcaucugcaucuga

SEQ ID NO: 12334 - RNA, 1701 nt, Artificial Sequence
  derived and/or modified CDS sequence (AUadapt) from InfluenzaA__AHZ35924__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcaggccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacguccaaguacagcaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucucggacacgcccgugcacgacugcaacacgaccugccagaccccgaagggcgccaucaacaccucccugcccuuccagaacauccaccccaucaccaucgggaagugccccaaguacgucaagagcaccaagcuccgccuggcgaccggccugcggaacgugccguccacgcagucgcgcgggcuguucggcgccaucgccggguucaucgagggcggcuggaccgggaugguggacggcugguacggguaccaccaccagaacgcccagggcuccggguacgccgcggaccucaagucgacccagaacgccaucgacaagaucaccaacaaggugaacuccgucaucgagaagaugaacacgcaguucaccgccgugggcaaggaguucaaccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggcgaagcucaaccgcgaggagaucgacggcgugaagcuggagagcacccggaucuaccagauccuggccaucuacuccaccgucgccucgagccucgugcugguggucucccugggggccaucucguucuggaugugcuccaacggcagccuccagugccgcaucugcaucuga

SEQ ID NO: 12335 - RNA, 1701 nt, Artificial Sequence
  derived and/or modified CDS sequence (AUadapt) from InfluenzaA__AHZ35935__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgcuucgagauguuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacaucccgagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 12336 - RNA, 1701 nt, Artificial Sequence; identical to SEQ ID NO: 12330
  derived and/or modified CDS sequence (AUadapt) from InfluenzaA__AHZ35946__HA

SEQ ID NO: 12337 - RNA, 1701 nt, Artificial Sequence; identical to SEQ ID NO: 12325
  derived and/or modified CDS sequence (AUadapt) from InfluenzaA__AHZ35958__HA

SEQ ID NO: 12338 - RNA, 1701 nt, Artificial Sequence; identical to SEQ ID NO: 12325
  derived and/or modified CDS sequence (AUadapt) from InfluenzaA__AHZ35980__HA

SEQ ID NO: 12339 - RNA, 1701 nt, Artificial Sequence; identical to SEQ ID NO: 12325
  derived and/or modified CDS sequence (AUadapt) from InfluenzaA__AHZ35991__HA

SEQ ID NO: 12340 - RNA, 1701 nt, Artificial Sequence; identical to SEQ ID NO: 12325
  derived and/or modified CDS sequence (AUadapt) from InfluenzaA__AHZ36002__HA

SEQ ID NO: 12341 - RNA, 1701 nt, Artificial Sequence
  derived and/or modified CDS sequence (AUadapt) from InfluenzaA__AHZ36013__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaaccgcaagcucugcaagcugcgcggggucgcgccccugcaccucggcaagugcaacaucgccggguggauccugggcaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgguucgagauguuccccaagacgucguccuggcccaaccacgacagcaacaagggcgucaccgccgccugcccgcacgccggggcgaaguccuucuacaagaaccugaucuggcucgugaagaagggcaacucguaccccaagcuguccaagagcuacaucaacgacaaggggaaggaggugcugguccucuggggcauccaccaccccucgaccaccgccgaccagcagucccuguaccagaacgccgacgccuacguguucguggggacgucgcgcuacuccaagaaguucaagcccgagaucgccauccggccgaagguccgcgaccaggagggccggaugaacuacuacuggacccugguggagcccggcgacaagaucaccuucgaggcgaccgggaaccucguggucccccgcuacgccuucgccauggagcggaacgccggcagcgggaucaucaucuccgacacgcccgugcacgacugcaacacgaccugccagaccccgaagggcgccaucaacaccucgcugcccuuccagaacauccaccccaucaccaucggcaagugccccaaguacgugaaguccaccaagcugcgccucgcgaccgggcugcggaacgucccgagcauccagucccgcggccuguucggggccaucgccggcuucaucgagggcggguggacgggcaugguggacgggugguacggcuaccaccaccagaacgagcaggggucgggcuacgccgccgaccucaaguccacccagaacgcgaucgacaagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgcgaggagaucgacggggugaagcucgagagcacccggaucuaccagauccuggcgaucuacuccaccgucgccucgucccuggugcucguggucagccugggcgccaucucguucuggaugugcuccaacgggagccugcagugccgcaucugcaucuga

SEQ ID NO: 12342 - RNA, 1701 nt, Artificial Sequence
  derived and/or modified CDS sequence (AUadapt) from InfluenzaA__AHZ36024__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagcugcggcucgcgacgggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagucgacccgcaccuaccagauccuggcgaucuacuccacggucgccucgucccuggugcucguggucagccugggggccaucucguucuggaugugcuccaacggcagccugcagugccggaucugcaucuga

SEQ ID NO: 12343 - RNA, 1701 nt, Artificial Sequence
  derived and/or modified CDS sequence (AUadapt) from InfluenzaA__AHZ36035__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugauccagucguccagcaccggggagaucugcaacucgccccaccagauccucgacggcgagaacugcacccugaucgacgcccugcucggggacccccagugcgacggcuuccagaacaagaagugggaccuguucgucgagcgcucgaaggcccacuccaacugcuaccccuacgacgugccggacuacgcgagccugcggucccucguggccucguccggcacgcuggaguucaacaacgagucguucaacuggaccggggucacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccgccgggcggaucaccgucucgacgaagcgcucccagcaggccgugaucccgaacaucggcagccggccccgcgugcggaacauccccucgcgcgucuccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacccccaacggcucgauccccaacgacaagccguuccagaacgugaaccgcaucacguacggggccugcccccgguacgucaagcagaacacccugaagcucgccaccggcaugcgcaacgugcccgagaagcagacccgggggaucuucggcgccaucgcgggguucaucgagaacggcugggagggcaugguggacgggugguacggcuuccgccaccagaacuccgaggggcggggccaggccgccgaccucaagucgacgcaggccgccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgcggagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacgucuaccgggacgaggcccucaacaaccgcuuccagaucaaggggguggagcugaaguccggcuacaaggacuggauccuguggaucagcuucgcgaucuccugcuuccuccugugcguggcccugcucggcuucaucaugugggccugccagaaggggaacauccggugcaacaucugcaucuga

SEQ ID NO: 12344 - RNA, 1701 nt, Artificial Sequence; identical to SEQ ID NO: 7100
  derived and/or modified CDS sequence (AUadapt) from InfluenzaA__AHZ36047__HA

SEQ ID NO: 12345 - RNA, 1701 nt, Artificial Sequence; identical to SEQ ID NO: 12325
  derived and/or modified CDS sequence (AUadapt) from InfluenzaA__AHZ36059__HA

SEQ ID NO: 12346 - RNA, 1701 nt, Artificial Sequence; identical to SEQ ID NO: 12342
  derived and/or modified CDS sequence (AUadapt) from InfluenzaA__AHZ36070__HA

SEQ ID NO: 12347 - RNA, 1701 nt, Artificial Sequence; identical to SEQ ID NO: 12341
  derived and/or modified CDS sequence (AUadapt) from InfluenzaA__AHZ36081__HA

SEQ ID NO: 12348 - RNA, 1701 nt, Artificial Sequence; identical to SEQ ID NO: 12342
  derived and/or modified CDS sequence (AUadapt) from InfluenzaA__AHZ36092__HA

SEQ ID NO: 12349 - RNA, 1701 nt, Artificial Sequence; identical to SEQ ID NO: 12325
  derived and/or modified CDS sequence (AUadapt) from InfluenzaA__AHZ36103__HA

SEQ ID NO: 12350 - RNA, 1701 nt, Artificial Sequence; identical to SEQ ID NO: 12342
  derived and/or modified CDS sequence (AUadapt) from InfluenzaA__AHZ36114__HA

SEQ ID NO: 12351 - RNA, 1701 nt, Artificial Sequence; identical to SEQ ID NO: 12325
  derived and/or modified CDS sequence (AUadapt) from InfluenzaA__AHZ36125__HA

SEQ ID NO: 12352 - RNA, 1701 nt, Artificial Sequence; identical to SEQ ID NO: 12325
  derived and/or modified CDS sequence (AUadapt) from InfluenzaA__AHZ36136__HA

SEQ ID NO: 12353 - RNA, 1701 nt, Artificial Sequence; identical to SEQ ID NO: 7100
  derived and/or modified CDS sequence (AUadapt) from InfluenzaA__AHZ36147__HA

SEQ ID NO: 12354 - RNA, 1701 nt, Artificial Sequence
  derived and/or modified CDS sequence (AUadapt) from InfluenzaA__AHZ36158__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugucguccuucgagcgcuucgagauguuccccaagacgagcuccuggcccaaccacgacucgaacaagggcgucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagcccgagaucgccacccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12355 - RNA, 1701 nt, Artificial Sequence; identical to SEQ ID NO: 12325
  derived and/or modified CDS sequence (AUadapt) from InfluenzaA__AHZ36169__HA

SEQ ID NO: 12356 - RNA, 1701 nt, Artificial Sequence
  derived and/or modified CDS sequence (AUadapt) from InfluenzaA__AHZ36180__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgcuucgagauguuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccauccacgacugcaacacgaccugccagaccccgaagggcgccaucaacaccucgcugcccuuccagaacauccaccccaucaccaucgggaagugccccaaguacgugaaguccaccaagcugcggcucgcgaccggccugcgcaacgugccgagcauccagucccgggggcuguucggcgccaucgccggguucaucgagggcggcuggacggggauggucgacggcugguacggguaccaccaccagaacgagcagggcucgggguacgccgccgaccucaaguccacccagaacgcgaucgacaagaucaccaacaaggugaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 12357 - RNA, 1701 nt, Artificial Sequence; identical to SEQ ID NO: 12330
  derived and/or modified CDS sequence (AUadapt) from InfluenzaA__AHZ36191__HA

SEQ ID NO: 12358 - RNA, 1701 nt, Artificial Sequence; identical to SEQ ID NO: 7100
  derived and/or modified CDS sequence (AUadapt) from InfluenzaA__AHZ36203__HA

SEQ ID NO: 12359 - RNA, 1701 nt, Artificial Sequence; identical to SEQ ID NO: 12325
  derived and/or modified CDS sequence (AUadapt) from InfluenzaA__AHZ36215__HA

SEQ ID NO: 12360 - RNA, 1701 nt, Artificial Sequence; identical to SEQ ID NO: 7100
  derived and/or modified CDS sequence (AUadapt) from InfluenzaA__AHZ36226__HA

SEQ ID NO: 12361 - RNA, 1701 nt, Artificial Sequence; identical to SEQ ID NO: 12325
  derived and/or modified CDS sequence (AUadapt) from InfluenzaA__AHZ36238__HA

SEQ ID NO: 12362 - RNA, 1701 nt, Artificial Sequence; identical to SEQ ID NO: 12325
  derived and/or modified CDS sequence (AUadapt) from InfluenzaA__AHZ36249__HA

SEQ ID NO: 12363 - RNA, 1701 nt, Artificial Sequence
  derived and/or modified CDS sequence (AUadapt) from InfluenzaA__AHZ36260__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgucguccuggagcuacaucguggagaccuucuccucggacaacgggaccugcuaccccggcgacuucaucaacuacgaggagcuccgggagcagcuguccagcguguccucguucgagcgcuucgagauguuccccaagacguccagcuggcccaaccacgacuccaacaagggcgucaccgccgccugcccgcacgccggcgccaagucguucuacaagaaccugaucuggcucgugaagaaggggaacuccuaccccaagcugagcaaguccuacaucaacgacaagggcaaggaggugcugguccucugggggauccaccaccccucgaccaccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccuccucgcuggugcucguggucucccugggggccaucagcuucuggaugugcagcaacggcucccugcagugccggaucugcaucuga

SEQ ID NO: 12364 - RNA, 1701 nt, Artificial Sequence; identical to SEQ ID NO: 12310
  derived and/or modified CDS sequence (AUadapt) from InfluenzaA__AHZ36271__HA

SEQ ID NO: 12365 - RNA, 1701 nt, Artificial Sequence; identical to SEQ ID NO: 12325
  derived and/or modified CDS sequence (AUadapt) from InfluenzaA__AHZ36283__HA

SEQ ID NO: 12366 - RNA, 1701 nt, Artificial Sequence; identical to SEQ ID NO: 12310
  derived and/or modified CDS sequence (AUadapt) from InfluenzaA__AHZ36294__HA

SEQ ID NO: 12367 - RNA, 1701 nt, Artificial Sequence
  derived and/or modified CDS sequence (AUadapt) from InfluenzaA__AHZ36306__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgcuucgagauguuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccucgcugcccuuccagaacauccaccccaucaccaucgggaagugccccaaguacgugaaguccaagaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcucgggguacgccgccgaccucaaguccacgcagaacgcgaucgacaagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12368 - RNA, 1701 nt, Artificial Sequence; identical to SEQ ID NO: 12325
  derived and/or modified CDS sequence (AUadapt) from InfluenzaA__AHZ36317__HA

SEQ ID NO: 12369 - RNA, 1701 nt, Artificial Sequence; identical to SEQ ID NO: 12325
  derived and/or modified CDS sequence (AUadapt) from InfluenzaA__AHZ36328__HA

SEQ ID NO: 12370 - RNA, 1701 nt, Artificial Sequence
  derived and/or modified CDS sequence (AUadapt) from InfluenzaA__AHZ36339__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgcuucgagauguuccccaagacgucguccuggcccaaccacgacagcaacaagggcgucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccgugaacaccucgcugcccuuccagaacauccaccccaucaccaucgggaagugccccaaguacgucaaguccaccaagcugcggcucgcgaccggccugcgcaacgugccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggucaacagcgugaucgagaagaugaacacccaguucacggccgucggcaaggaguucaaccaccuggagcgccggaucgagaaccugaacaagaagguggacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcucgagagcacccggaucuaccagauccuggcgaucuacuccaccguggccucgucccuggugcucgucgugagccugggggccaucucguucuggaugugcuccaacggcagccugcagugccgcaucugcaucuga

SEQ ID NO: 12371 - RNA, 1701 nt, Artificial Sequence
  derived and/or modified CDS sequence (AUadapt) from InfluenzaA__AHZ36362__HA
augaaggccauccuggugguccuccuguacaccuucgccaucgcgaacgccgacacccugugcaucggcuaccacgccaacaacucgacggacaccguggacaccgugcucgagaagaacgucaccgugacgcacuccaucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacgggaccugcuaccccggcgacuucaucaacuacgaggagcuccgggagcagcugucguccgugagcuccuucgagcgcuucgagauguuccccaagacgucguccuggcccaaccacgacagcaacaagggcgugaccgccgccugcccgcacgccggcgcgaaguccuucuacaagaaccugaucuggcucgucaagaaggggaacucguaccccaagcuguccaagagcuacaucaacgacaagggcaaggaggugcuggugcucugggggauccaccaccccucgaccaccgccgaccagcagucccuguaccagaacgccgacgccuacgucuucgugggcacgucgcgguacuccaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccgggagcggcaucaucaucuccgacacgcccguccacgacugcaacacgaccugccagaccccgaagggcgccgugaacaccucgcugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcucgggguacgccgccgaccucaaguccacccagaacgcgaucgacaagaucaccaacaaggugaacagcgucaucgagaagaugaacacccaguucacggccgugggcaaggaguucaaccaccuggagcgccggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 12372 - RNA, 1701 nt, Artificial Sequence
  derived and/or modified CDS sequence (AUadapt) from InfluenzaA__AHZ36385__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcagccagcaggccgugaucccgaacaucgggucgcggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacucggagggccgggggcaggcggccgaccucaaguccacgcaggccgccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacgacgucuaccgggacgaggcccugaacaaccgcuucaagaucaagggcguggagcucaagucgggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 12373 - RNA, 1701 nt, Artificial Sequence
  derived and/or modified CDS sequence (AUadapt) from InfluenzaA__AHZ36397__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcagccagcaggccgugaucccgaacaucgggucgcggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacucggagggccgggggcaggcggccgaccucaaguccacgcaggccgccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgccugcaucggcuccauccgcaacgggaccuacgaccacaacgucuaccgggacgaggcccugaacaaccgcuucaagaucaagggcguggagcucaagucgggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 12374 - RNA, 1701 nt, Artificial Sequence; identical to SEQ ID NO: 12310
  derived and/or modified CDS sequence (AUadapt) from InfluenzaA__AHZ36409__HA

SEQ ID NO: 12375 - RNA, 1701 nt, Artificial Sequence; identical to SEQ ID NO: 12311
  derived and/or modified CDS sequence (AUadapt) from InfluenzaA__AHZ36433__HA

SEQ ID NO: 12376 - RNA, 1701 nt, Artificial Sequence
  derived and/or modified CDS sequence (AUadapt) from InfluenzaA__AHZ36445__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcagccagcaggccgugaucccgaacaucgggucgcggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacagcgcgugcaucacccccaacggcuccauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacucggagggccgggggcaggcggccgaccucaaguccacgcaggccgccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagaccaagaagcagcuccgcgagaacgccgaggacaugggcaacgggugcuucaagaucuaccacaagugcgacgacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcucugcguggcgcugcugggcuucaucaugugggccugccagaagggcaacauccggugcaacaucugcaucuga

SEQ ID NO: 12377 - RNA, 1701 nt, Artificial Sequence; identical to SEQ ID NO: 12310
  derived and/or modified CDS sequence (AUadapt) from InfluenzaA__AHZ36457__HA

SEQ ID NO: 12378 - RNA, 1701 nt, Artificial Sequence; identical to SEQ ID NO: 12310
  derived and/or modified CDS sequence (AUadapt) from InfluenzaA__AHZ36469__HA

SEQ ID NO: 12379 - RNA, 1701 nt, Artificial Sequence
  derived and/or modified CDS sequence (AUadapt) from InfluenzaA__AHZ36481__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccucggccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcucgcagcaggccgugaucccgaacaucgggagccggccccgcgugcggaacauccccucccgcgucucgaucuacuggaccaucgugaagcccggcgacauccugcugaucaacuccaccggcaaccucaucgccccgcggggguacuucaagauccgcaacggcaagucguccaucaugcggagcgacgcccccaucgggaagugcaacuccgcgugcaucacccccaacggcucgauccccaacgacaagccguuccagaacgugaaccgcaucacguacggcgccugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacuccgagggccgggggcaggcggccgaccucaagucgacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcgcuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgccugcaucggcucgauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcguggcgcugcugggcuucaucaugugggccugccagaagggcaacauccggugcaacaucugcaucuga

SEQ ID NO: 12380 - RNA, 1701 nt, Artificial Sequence; identical to SEQ ID NO: 12311
  derived and/or modified CDS sequence (AUadapt) from InfluenzaA__AHZ36493__HA

SEQ ID NO: 12381 - RNA, 1701 nt, Artificial Sequence; identical to SEQ ID NO: 12311
  derived and/or modified CDS sequence (AUadapt) from InfluenzaA__AHZ36505__HA

SEQ ID NO: 12382 - RNA, 1701 nt, Artificial Sequence; identical to SEQ ID NO: 12311
  derived and/or modified CDS sequence (AUadapt) from InfluenzaA__AHZ36517__HA

SEQ ID NO: 12383 - RNA, 1701 nt, Artificial Sequence
  derived and/or modified CDS sequence (AUadapt) from InfluenzaA__AHZ36529__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaagaagugggaccucuucgucgagcgcuccaaggcccacuccaacugcuaccccuacgacgugccggacuacgcgagccugcggucccugguggccucguccggcacgcucgaguucaacaacgagagcuucaacuggaccggcgucacccagaacgggaccuccucggccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccagcggccggaucaccgucuccacgaagcgcucgcagcaggccgugaucccgaacaucgggagccggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacucguccugcaucacccccaacggcagcauccccaacgacaagccguuccagaacgugaaccgcaucacguacggcgcgugcccccgguacgucaagcagaacacccugaagcuggccaccgggaugcgcaacgugcccgagaagcagacccggggcaucuucggggccaucgccggcuucaucgagaacgggugggagggcaugguggacggcugguacggguuccgccaccagaacuccgagggccgggggcaggccgcggaccucaagucgacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacaugggcaacgggugcuucaagaucuaccacaagugcgacaacgccugcaucggcucgauccgcaacgggaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggcgugccagaagggcaacauccggugcaacaucugcaucuga

SEQ ID NO: 12384 - RNA, 1701 nt, Artificial Sequence; identical to SEQ ID NO: 12310
  derived and/or modified CDS sequence (AUadapt) from InfluenzaA__AHZ36541__HA

SEQ ID NO: 12385 - RNA, 1701 nt, Artificial Sequence
  derived and/or modified CDS sequence (AUadapt) from InfluenzaA__AHZ36553__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaaggagugggaccucuucgucgagcgcuccaaggcccacuccaacugcuaccccuacgacgugccggacuacgcgucgcugcggucccugguggccagcuccggcacgcucgaguucaagaacgagucguucaacuggaccggcgucacccagaacgggaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcagccagcaggccgugaucccgaacaucgggucgcggccccgcgugcggaacauccccucccgcgucucgaucuacuggaccaucgugaagcccggcgacauccugcugaucaacuccaccggcaaccucaucgccccgcggggguacuucaagauccgcagcggcaaguccucgaucaugcgguccgacgcccccaucgggaagugcaacagcgcgugcaucacccccaacggcuccauccccaacgacaagccguuccagaacgugaaccgcaucacguacgggaccugcccccgguacgucaagcagaacacccugaagcuggccaccggcaugcgcaacgugcccgagaagcagacgcggggcaucuucggggccaucgccggcuucaucgagaacgggugggagggcaugguggacggcugguacggguuccgccaccagaacucggagggccgggggcaggccgcggaccucaaguccacccaggccgccaucgaccagaucaacggcaagcugaaccgccugaucgggaagaccaacgagaaguuccaccagaucgagaaggaguucucggaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccaucagcugcuuccugcucugcguggcccugcugggcuucaucaugugggcgugccagaagggcaacauccggugcaacaucugcaucuga

SEQ ID NO: 12386 - RNA, 1701 nt, Artificial Sequence; identical to SEQ ID NO: 12310
  derived and/or modified CDS sequence (AUadapt) from InfluenzaA__AHZ36565__HA

SEQ ID NO: 12387 - RNA, 1701 nt, Artificial Sequence; identical to SEQ ID NO: 12310
  derived and/or modified CDS sequence (AUadapt) from InfluenzaA__AHZ36577__HA

SEQ ID NO: 12388 - RNA, 1701 nt, Artificial Sequence; identical to SEQ ID NO: 12310
  derived and/or modified CDS sequence (AUadapt) from InfluenzaA__AHZ36589__HA

SEQ ID NO: 12389 - RNA, 1701 nt, Artificial Sequence; identical to SEQ ID NO: 12385
  derived and/or modified CDS sequence (AUadapt) from InfluenzaA__AHZ36601__HA

SEQ ID NO: 12390 - RNA, 1701 nt, Artificial Sequence
  derived and/or modified CDS sequence (AUadapt) from InfluenzaA__AHZ36613__HA
augaagaccaucaucgcccugucguacauccucugccugaucuucgcccaggagauccccggcaacgacaacuccaccgcgacgcugugccucgggcaccacgccgugccgaacggcaccaucgucaagaccaucaccaacgaccagaucgaggugacgaacgccaccgagcuggugcagucguccagcaccggggagaucugcaacucgccccaccagauccuggacggcgagaacugcacccucaucgacgcccugcugggggacccccagugcgacgacuuccagaacaaggagugggaccucuucgucgagcgcuccaaggcccacuccaacugcuaccccuacgacgugccggacuacgcgucgcugcggucccugguggccagcuccggcacgcucgaguucaacaacgagucguucaacuggaccggcgucacccagaacgggaccuccucggccugcauccgccgguccaacaacagcuucuucucccgccugaacuggcugacgcaccucaacuucaaguaccccgcccugaacgugaccaugcccaacaacgagcaguucgacaagcuguacaucuggggcgugcaccaccccgggaccgacaaggaccagaucuuccucuacgcgcaggccucgggccggaucaccgucuccacgaagcgcucgcagcaggccgugaucccgaacaucgggagccggccccgcgugcggaacauccccucccgcgucucgaucuacuggaccaucgugaagcccggcgacauccugcugaucaacuccaccggcaaccucaucgccccgcggggguacuucaagauccgcucgggcaaguccagcaucaugcgguccgacgcccccaucgggaagugcaacucggcgugcaucacccccaacggcuccauccccaacgacaagccguuccagaacgugaaccgcaucacguacgggaccugcccccgguacgucaagcagaacacccugaagcuggccaccggcaugcgcaacgugcccgagaagcagacgcggggcaucuucggggccaucgccggcuucaucgagaacgggugggagggcaugguggacggcugguacggguuccgccaccagaacucggagggccgggggcaggccgcggaccucaaguccacccaggccgccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagucgggguacaaggacuggauccuguggaucuccuucgccacgagcugcuuccugcucugcguggcccugcugggcuucaucaugugggcgugccagaagggcaacauccggugcaacaucugcaucuga

SEQ ID NO: 12391 - RNA, 1701 nt, Artificial Sequence; identical to SEQ ID NO: 12310
  derived and/or modified CDS sequence (AUadapt) from InfluenzaA__AHZ36625__HA

SEQ ID NO: 12392 - RNA, 1701 nt, Artificial Sequence; identical to SEQ ID NO: 12311
  derived and/or modified CDS sequence (AUadapt) from InfluenzaA__AHZ36637__HA

SEQ ID NO: 12393 - RNA, 1701 nt, Artificial Sequence; identical to SEQ ID NO: 12311
  derived and/or modified CDS sequence (AUadapt) from InfluenzaA__AHZ36649__HA

SEQ ID NO: 12394 - RNA, 1701 nt, Artificial Sequence; identical to SEQ ID NO: 162
  derived and/or modified CDS sequence (AUadapt) from InfluenzaA__AHZ36661__HA

SEQ ID NO: 12395 - RNA, 1701 nt, Artificial Sequence; identical to SEQ ID NO: 162
  derived and/or modified CDS sequence (AUadapt) from InfluenzaA__AHZ36673__HA

SEQ ID NO: 12396 - RNA, 1701 nt, Artificial Sequence
  derived and/or modified CDS sequence (AUadapt) from InfluenzaA__AHZ36685__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagcgggucgagcucaagagcggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 12397 - RNA, 1683 nt, Artificial Sequence; identical to SEQ ID NO: 86
  derived and/or modified CDS sequence (AUadapt) from InfluenzaA__AHZ39698__HA

SEQ ID NO: 12398 - RNA, 1683 nt, Artificial Sequence
  derived and/or modified CDS sequence (AUadapt) from InfluenzaA__AHZ39722__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaauuccucgaguucagugccgaccugaucaucgagcgccgggagggguccgacgugugcuaccccggcaaguucgugaacgaggaggcccugcgccagauccuccgggagagcgggggcaucgacaaggaggcgaugggguuuaccuacuccggcauccgcaccgacggcgccaccagcgccugccggcgcuccgggagcuccuucuacgccgaaaugaaguggcugcugagcaacacggaugacgcggccuucccgcagaugaccaaguccuacaagaacacccgcaagagccccgcccucaucgucuggggcauccaccacuccgugagcaccgccgagcagacgaagcuguauggguccggcaacaagcuggugaccgucggcagcuccaacuaccagcaaagcuucgugcccucccccggggcccggccccaggugaacggccucagcgggcggaucgacuuucacuggcugaugcugaaccccaacgacaccgucaccuucagcuucaacggcgcguuuaucgcccccgaccgcgccuccuuccuccggggcaagagcauggggauccaguccggcguccagguggacgccaacugcgagggggacugcuaccauagcggcgggacgaucaucuccaaccugcccuuccagaacaucgacagccgcgccgugggcaagugcccgcgguacgugaagcagcgcucccugcuccuggcgaccgggaugaagaaugugcccgaaauccccaagggccggggccuguucggggccaucgccggcuucaucgagaacgggugggagggccucaucgacgggugguacggcuuccgccaccagaacgcccagggcgaggggaccgccgcggacuauaagagcacccaguccgccaucgaccagaucacgggcaagcugaaccggcugaucgaaaagaccaaccagcaguucgagcucaucgacaacgaguucaaugaggucgagaagcagaucgggaacgugaucaacuggacccgcgacagcaucaccgaggugugguccuacaacgccgaacugcuggucgccauggagaaccagcacacgaucgaccucgccgauagcgagauggacaagcuguacgagcgcgugaagcggcagcugcgcgagaacgcggaggaggacggcaccggcugcuucgaaaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 12399 - RNA, 1683 nt, Artificial Sequence; identical to SEQ ID NO: 12398
  derived and/or modified CDS sequence (AUadapt) from InfluenzaA__AHZ39734__HA

SEQ ID NO: 12400 - RNA, 1683 nt, Artificial Sequence
  derived and/or modified CDS sequence (AUadapt) from InfluenzaA__AHZ39746__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaguucagugccgaccugaucaucgagcgccgggagggguccgacgugugcuaccccggcaaguucgugaacgaggaagcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggauaacgcggccuucccgcagaugaccaaguccuacaagaacacccgcaagagccccgcccucaucgucuggggcauccaccacuccgugagcaccgccgagcagacgaagcuguauggguccggcaacaagcuggugaccgucggcagcuccaacuaccagcagagcuucgugcccucccccggggagcggccccaagugaacggccucagcgggcggaucgacuuucacuggcugaugcugaaccccaacgacaccgucaccuucagcuucaacggcgccuuuaucgcgcccgaccgcgccuccuuccuccggggcaagagcauggggauccaguccggcguccagguggacgccaacugcgagggggacugcuaccauagcggcgggacgaucaucuccaaccugcccuuccagaacaucgacagccgcgccgugggcaagugcccgcgguacgugaagcagcgcucccugcuccuggccaccgggaugaagaaugugcccgagauccccaagggccggggccuguucggggcgaucgccggcuucaucgagaacgggugggagggccucaucgacgggugguacggcuuccgccaccagaacgcccagggcgaggggaccgccgccgacuauaagagcacccaauccgcgaucgaccagaucacgggcaagcugaaccggcugaucgagaagaccaaccagcaguucgagcucaucgacaacgaguucaaugaggucgagaagcagaucgggaacgugaucaacuggacccgcgacagcaucaccgaggugugguccuacaacgccgagcugcuggucgccauggagaaccagcacacgaucgaccucgccgauagcgagauggacaaacuguacgagcgcgugaagcggcagcugcgcgagaacgccgaggaggacggcaccggcugcuucgagaucuuccauaagugcgacgacgacugcauggcguccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgccaucgugauggggcuggucuucaucugcgugaagaacggcaacaugcgcugcaccaucugcaucuga

SEQ ID NO: 12401 - RNA, 1683 nt, Artificial Sequence; identical to SEQ ID NO: 12398
  derived and/or modified CDS sequence (AUadapt) from InfluenzaA__AHZ39758__HA

SEQ ID NO: 12402 - RNA, 1683 nt, Artificial Sequence; identical to SEQ ID NO: 12398
  derived and/or modified CDS sequence (AUadapt) from InfluenzaA__AHZ39770__HA

SEQ ID NO: 12403 - RNA, 1683 nt, Artificial Sequence; identical to SEQ ID NO: 12398
  derived and/or modified CDS sequence (AUadapt) from InfluenzaA__AHZ39782__HA

SEQ ID NO: 12404 - RNA, 1701 nt, Artificial Sequence; identical to SEQ ID NO: 10128
  derived and/or modified CDS sequence (AUadapt) from InfluenzaA__AHZ39794__HA

SEQ ID NO: 12405 - RNA, 1701 nt, Artificial Sequence; identical to SEQ ID NO: 10242
  derived and/or modified CDS sequence (AUadapt) from InfluenzaA__AHZ39806__HA

SEQ ID NO: 12406 - RNA, 1701 nt, Artificial Sequence
  derived and/or modified CDS sequence (AUadapt) from InfluenzaA__AHZ39818__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaccuuccuguacgcgcaggccgccgggcggaucacggugucgaccaagcgcucccagcaggccgugaucccgaacaucggcagccggccccgcguccggaacauccccucgcgcguguccaucuacuggaccaucgugaagcccggcgacauccugcucaucaacucgaccgggaaccugaucgccccgcggggcuacuucaagauccgcuccgggaaguccuccaucaugcggagcgacgcgcccaucggcaagugcaacuccgccugcaucacgcccaacggcucgauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgccaucgcgggguucaucgagaacggcugggagggcauggucgacgggugguacggcuuccgccaccagaacuccgaggggcggggccaggccgccgaccucaagucgacccaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgcggagcucaucgucgcccuggagaaccagcacacgaucgaccugaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccugaacaaccgcuuccagaucaaggggguggagcucaaguccggcuacaaggacuggauccuguggaucagcuucgcgaucuccugcuuccugcucugcgucgugcugcugggcuucaucaugugggccugccagaaggggaacauccggugcaacaucugcaucuga

SEQ ID NO: 12407 - RNA, 1701 nt, Artificial Sequence; identical to SEQ ID NO: 10128
  derived and/or modified CDS sequence (AUadapt) from InfluenzaA__AHZ39841__HA

SEQ ID NO: 12408 - RNA, 1701 nt, Artificial Sequence; identical to SEQ ID NO: 10148
  derived and/or modified CDS sequence (AUadapt) from InfluenzaA__AHZ39853__HA

SEQ ID NO: 12409 - RNA, 1701 nt, Artificial Sequence; identical to SEQ ID NO: 10128
  derived and/or modified CDS sequence (AUadapt) from InfluenzaA__AHZ39865__HA

SEQ ID NO: 12410 - RNA, 1701 nt, Artificial Sequence
  derived and/or modified CDS sequence (AUadapt) from InfluenzaA__AHZ39877__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagucgggcuacaaggacuggauccuguggaucuccuucgccaccagcugcuuccugcugugcguggcccugcucggcuucaucaugugggccugccagaaggggaacauccgcugcaacaucugcaucuga

SEQ ID NO: 12411 - RNA, 1701 nt, Artificial Sequence; identical to SEQ ID NO: 10148
  derived and/or modified CDS sequence (AUadapt) from InfluenzaA__AHZ39889__HA

SEQ ID NO: 12412 - RNA, 1701 nt, Artificial Sequence; identical to SEQ ID NO: 10129
  derived and/or modified CDS sequence (AUadapt) from InfluenzaA__AHZ39913__HA

SEQ ID NO: 12413 - RNA, 1701 nt, Artificial Sequence
  derived and/or modified CDS sequence (AUadapt) from InfluenzaA__AHZ39925__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcgacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12414 - RNA, 1701 nt, Artificial Sequence; identical to SEQ ID NO: 10128
  derived and/or modified CDS sequence (AUadapt) from InfluenzaA__AHZ39937__HA

SEQ ID NO: 12415 - RNA, 1701 nt, Artificial Sequence; identical to SEQ ID NO: 10128
  derived and/or modified CDS sequence (AUadapt) from InfluenzaA__AHZ39949__HA

SEQ ID NO: 12416 - RNA, 1701 nt, Artificial Sequence; identical to SEQ ID NO: 10128
  derived and/or modified CDS sequence (AUadapt) from InfluenzaA__AHZ39961__HA

SEQ ID NO: 12417 - RNA, 1701 nt, Artificial Sequence; identical to SEQ ID NO: 10128
  derived and/or modified CDS sequence (AUadapt) from InfluenzaA__AHZ39973__HA

SEQ ID NO: 12418 - RNA, 1701 nt, Artificial Sequence
  derived and/or modified CDS sequence (AUadapt) from InfluenzaA__AHZ39985__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgccuccaucgggaagugcaagucggagugcaucacccccaacggcuccauccccaacgacaagcccuuccagaacgugaaccggaucaccuacggggccugcccgcgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacaacguguaccgcgacgaggcccucaacaaccgguuccagaucaagggggucgagcugaaguccggcuacaaggacuggauccuguggaucagcuucgccaccagcugcuuccuccugugcguggcccugcucggcuucaucaugugggccugccagaaggggaacauccgcugcaacaucugcaucuga

SEQ ID NO: 12419 - RNA, 1701 nt, Artificial Sequence; identical to SEQ ID NO: 10128
  derived and/or modified CDS sequence (AUadapt) from InfluenzaA__AHZ39997__HA

SEQ ID NO: 12420 - RNA, 1701 nt, Artificial Sequence
  derived and/or modified CDS sequence (AUadapt) from InfluenzaA__AHZ40009__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaucagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccgcaagucgaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcggaucaccgugagcaccaagcgcagccagcaggccgugaucccgaacaucggcucccggccccgcauccggaacauccccucgcgcaucuccaucuacuggacgaucgucaagcccggcgacauccugcucaucaacagcaccgggaaccugaucgccccgcggggcuacuucaagauccgcuccggcaagucguccaucaugcggagcgacgcccccaucgggaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 12421 - RNA, 1701 nt, Artificial Sequence; identical to SEQ ID NO: 10128
  derived and/or modified CDS sequence (AUadapt) from InfluenzaA__AHZ40021__HA

SEQ ID NO: 12422 - RNA, 1701 nt, Artificial Sequence; identical to SEQ ID NO: 10103
  derived and/or modified CDS sequence (AUadapt) from InfluenzaA__AHZ40033__HA

SEQ ID NO: 12423 - RNA, 1701 nt, Artificial Sequence; identical to SEQ ID NO: 10128
  derived and/or modified CDS sequence (AUadapt) from InfluenzaA__AHZ40045__HA

SEQ ID NO: 12424 - RNA, 1701 nt, Artificial Sequence; identical to SEQ ID NO: 10128
  derived and/or modified CDS sequence (AUadapt) from InfluenzaA__AHZ40060__HA

SEQ ID NO: 12425 - RNA, 1701 nt, Artificial Sequence; identical to SEQ ID NO: 10128
  derived and/or modified CDS sequence (AUadapt) from InfluenzaA__AHZ40072__HA

SEQ ID NO: 12426 - RNA, 1701 nt, Artificial Sequence; identical to SEQ ID NO: 10128
  derived and/or modified CDS sequence (AUadapt) from InfluenzaA__AHZ40084__HA

SEQ ID NO: 12427 - RNA, 1701 nt, Artificial Sequence; identical to SEQ ID NO: 10128
  derived and/or modified CDS sequence (AUadapt) from InfluenzaA__AHZ40096__HA

SEQ ID NO: 12428 - RNA, 1701 nt, Artificial Sequence; identical to SEQ ID NO: 10129
  derived and/or modified CDS sequence (AUadapt) from InfluenzaA__AHZ40108__HA

SEQ ID NO: 12429 - RNA, 1701 nt, Artificial Sequence; identical to SEQ ID NO: 10242
  derived and/or modified CDS sequence (AUadapt) from InfluenzaA__AHZ40120__HA

SEQ ID NO: 12430 - RNA, 1701 nt, Artificial Sequence
  derived and/or modified CDS sequence (AUadapt) from InfluenzaA__AHZ40130__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaagaacuggauccuguggaucuccuucgccaucagcugcuuccugcugugcguggcccugcucggcuucaucaugugggccugccagaaggggaacauccgcugcaacaucugcaucuga

SEQ ID NO: 12431 - RNA, 1701 nt, Artificial Sequence
  derived and/or modified CDS sequence (AUadapt) from InfluenzaA__AHZ40142__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccaggacaagaagugggaccuguucguggagcgguccaaggccuacagcaacugcuaccccuacgacgugccggacuacgcgucccugcgcucgcucgucgccuccagcggcacccuggaguucaacaacgagaacuucaacuggacgggggugacccagaacggcaccuccucggccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgaccggccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgggagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 12432 - RNA, 1701 nt, Artificial Sequence
  derived and/or modified CDS sequence (AUadapt) from InfluenzaA__AHZ40154__HA
augaagaccaucaucgcccugucguacauccucugccugggcuucgcccaggagcugcccgggaacgacaacuccaccgcgacgcucugccugggccaccacgccgugccgaacgggaccaucgucaagaccaucaccaacgaccagaucgaggugacgaacgccaccgagcuggugcagucguccagcaccggcgagaucugcaacucgccccaccagauccucgacggggagaacugcacccugaucgacgcccugcucggcgacccccagugcgacggcuuccagaacaagaagugggaccuguucgucgagcgcucgaaggcccacuccaacugcuaccccuacgacgugccggacuacgcgagccugcggucccucguggccucguccgggacgcuggaguucaacaacgagucguucaacuggaccggcgucacccagaacgggaccuccagcgccugcauccgcggcuccaacaacucguucuucucccggcugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccucgggccgcaucaccgucuccacgaagcggagccagcaggccgugaucccgaacaucgggucgcgcccccgggugcgcaacauccccucccgggucucgaucuacuggaccaucgugaagcccggcgacaugcugcucaucaacuccaccgggaaccugaucgccccgcgcggcuacuucaagauccggagcggcaaguccucgaucaugcgcuccgacgcccccaucgggaagugcaacucggcgugcaucacccccaacggcuccauccccaacgacaagccguuccagaacgugaaccggaucacguacggggccugcccccgcuacgucaagcagaacacccugaagcucgccaccggcaugcggaacgugcccgagaagcagacccgcgggaucuucggcgccaucgccggcuucaucgagaacgggugggagggcaugguggacgggugguacggcuuccggcaccagaacagcgaggggcgcggccaggcggccgaccugaaguccacgcaggccgccaucgaccagaucaacggcaagcugaaccggcucaucgggaagaccaacgagaaguuccaccagaucgagaaggaguucucggaggucgagggccgcauccaggaccuggagaaguacguggaggacaccaagaucgaccugugguccuacaacgccgagcuccugguggcgcuggagaaccagcacaccaucgaccucacggacucggagaugaacaagcuguucgagaagaccaagaagcagcugcgggagaacgccgaggacauggggaacggcugcuucaagaucuaccacaagugcaacaacgccugcaucggguccauccgcaacggcaccuacgaccacgacgucuaccgcgacgaggcccucaacaaccgguuccagaucaagggcguggagcugaaguccggguacaaggacuggauccuguggaucuccuucgccaucagcugcuuccuccugugcguggcgcugcucggcuucaucaugugggccugccagaaggggaacauccgcugcaacaucugcaucuga

SEQ ID NO: 12433 - RNA, 1701 nt, Artificial Sequence
  derived and/or modified CDS sequence (AUadapt) from InfluenzaA__AHZ40166__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgggucgggcaucaucaucuccgacacccccguccacgacugcaacacgaccugccagaccccggagggcgccaucaacaccagccugcccuuccagaacauccaccccaucaccaucgggcggugccccaaguacgugaaguccaccaagcugcgccucgcgacgggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 12434 - RNA, 1701 nt, Artificial Sequence; identical to SEQ ID NO: 10128
  derived and/or modified CDS sequence (AUadapt) from InfluenzaA__AHZ40177__HA

SEQ ID NO: 12435 - RNA, 1701 nt, Artificial Sequence; identical to SEQ ID NO: 10128
  derived and/or modified CDS sequence (AUadapt) from InfluenzaA__AHZ40189__HA

SEQ ID NO: 12436 - RNA, 1701 nt, Artificial Sequence; identical to SEQ ID NO: 10128
  derived and/or modified CDS sequence (AUadapt) from InfluenzaA__AHZ40201__HA

SEQ ID NO: 12437 - RNA, 1701 nt, Artificial Sequence; identical to SEQ ID NO: 10113
  derived and/or modified CDS sequence (AUadapt) from InfluenzaA__AHZ40213__HA

SEQ ID NO: 12438 - RNA, 1701 nt, Artificial Sequence; identical to SEQ ID NO: 10080
  derived and/or modified CDS sequence (AUadapt) from InfluenzaA__AHZ40225__HA

SEQ ID NO: 12439 - RNA, 1701 nt, Artificial Sequence
  derived and/or modified CDS sequence (AUadapt) from InfluenzaA__AHZ40237__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaccgacaagccguuccagaacgugaaccggaucaccuacggcgcgugcccccgcuacgugaagcaguccacgcugaagcucgccaccgggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgcggaggacaugggcaacgggugcuucaagaucuaccacaagugcgacaacgccugcaucggcuccauccgcaacgggaccuacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 12440 - RNA, 1701 nt, Artificial Sequence; identical to SEQ ID NO: 10136
  derived and/or modified CDS sequence (AUadapt) from InfluenzaA__AHZ40249__HA

SEQ ID NO: 12441 - RNA, 1701 nt, Artificial Sequence; identical to SEQ ID NO: 10103
  derived and/or modified CDS sequence (AUadapt) from InfluenzaA__AHZ40261__HA

SEQ ID NO: 12442 - RNA, 1701 nt, Artificial Sequence; identical to SEQ ID NO: 10242
  derived and/or modified CDS sequence (AUadapt) from InfluenzaA__AHZ40273__HA

SEQ ID NO: 12443 - RNA, 1701 nt, Artificial Sequence
  derived and/or modified CDS sequence (AUadapt) from InfluenzaA__AHZ40285__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccgacagcuccuucuucucgcgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcucgcagcaguccgugaucccgaacaucggcagccggccccgcauccggaacauccccucccgcaucucgaucuacuggaccaucgucaagcccggcgacauccugcucaucaacuccaccgggaaccugaucgccccgcggggcuacuucaagauccagagcgggaaguccucgaucaugcgcuccgacacccccaucggcaagugcaacagcgagugcaucacgcccaacggcuccauccccaacgacaagccguuccagaacgugaaccggaucaccuacggggccugcccccgcuacgugaagcagaacacccugaagcucgccaccggcaugcggaacguccccgagaagcagacgcgcgggaucuucggcgcgaucgccggguucaucgagaacggcugggagggcaugguggacgggugguacggcuuccggcaccagaacucggaggggcgcggccaggccgccgaccugaaguccacccaggccgcgaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgccugcaucggguccauccgcaacggcaccuacaaccacgacguguaccgcgacgaggcgcucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 12444 - RNA, 1701 nt, Artificial Sequence; identical to SEQ ID NO: 162
  derived and/or modified CDS sequence (AUadapt) from InfluenzaA__AHZ40297__HA

SEQ ID NO: 12445 - RNA, 1701 nt, Artificial Sequence
  derived and/or modified CDS sequence (AUadapt) from InfluenzaA__AHZ40309__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggaacggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggugcugcucggcuucaucaugugggccugccagaaggggaacauccgcugcaacaucugcaucuga

SEQ ID NO: 12446 - RNA, 1701 nt, Artificial Sequence; identical to SEQ ID NO: 10128
  derived and/or modified CDS sequence (AUadapt) from InfluenzaA__AHZ40321__HA

SEQ ID NO: 12447 - RNA, 1701 nt, Artificial Sequence; identical to SEQ ID NO: 10128
  derived and/or modified CDS sequence (AUadapt) from InfluenzaA__AHZ40333__HA

SEQ ID NO: 12448 - RNA, 1701 nt, Artificial Sequence
  derived and/or modified CDS sequence (AUadapt) from InfluenzaA__AHZ40345__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcagcgacgcccccaucgggaagugcaaguccgagugcaucacccccaacggcucgauccccuccgacaagccguuccagaacgugaaccggaucaccuacggggccugcccccgcuacgugaagcagagcacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 12449 - RNA, 1701 nt, Artificial Sequence; identical to SEQ ID NO: 10129
  derived and/or modified CDS sequence (AUadapt) from InfluenzaA__AHZ40357__HA

SEQ ID NO: 12450 - RNA, 1701 nt, Artificial Sequence
  derived and/or modified CDS sequence (AUadapt) from InfluenzaA__AHZ40369__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccgggcgcagcuccaucaugcggucggacgcccccaucggcaagugcaaguccgagugcaucacccccaacggcagcauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 12451 - RNA, 1701 nt, Artificial Sequence; identical to SEQ ID NO: 162
  derived and/or modified CDS sequence (AUadapt) from InfluenzaA__AHZ40381__HA

SEQ ID NO: 12452 - RNA, 1701 nt, Artificial Sequence; identical to SEQ ID NO: 10128
  derived and/or modified CDS sequence (AUadapt) from InfluenzaA__AHZ40393__HA

SEQ ID NO: 12453 - RNA, 1701 nt, Artificial Sequence; identical to SEQ ID NO: 10128
  derived and/or modified CDS sequence (AUadapt) from InfluenzaA__AHZ40405__HA

SEQ ID NO: 12454 - RNA, 1701 nt, Artificial Sequence; identical to SEQ ID NO: 10128
  derived and/or modified CDS sequence (AUadapt) from InfluenzaA__AHZ40417__HA

SEQ ID NO: 12455 - RNA, 1701 nt, Artificial Sequence
  derived and/or modified CDS sequence (AUadapt) from InfluenzaA__AHZ40429__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaagaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 12456 - RNA, 1701 nt, Artificial Sequence; identical to SEQ ID NO: 10128
  derived and/or modified CDS sequence (AUadapt) from InfluenzaA__AHZ40441__HA

SEQ ID NO: 12457 - RNA, 1701 nt, Artificial Sequence; identical to SEQ ID NO: 10271
  derived and/or modified CDS sequence (AUadapt) from InfluenzaA__AHZ40453__HA

SEQ ID NO: 12458 - RNA, 1701 nt, Artificial Sequence
  derived and/or modified CDS sequence (AUadapt) from InfluenzaA__AHZ40465__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacaugccggacuacgcgucccugcgcucgcucguggccuccagcggcacccuggaguucaacaacgaguccuucaacuggacgggggucacccagaacggcaccucguccgccugcauccggcgcagcaacuccucguucuucucccggcugaacuggcucacccaccugaacuucaaguaccccgcccugaacgugacgaugcccaacaacgagcgcuucgacaagcucuacaucuggggcgugcaccaccccgggaccgacaaggaccagaucuuccuguacgcgcagagcuccgggcggaucaccgucagcaccaagcgcucgcagcaggccgugaucccgaacaucggcucccggccccgcauccggaacauccccagccgcaucuccaucuacuggacgaucgugaagcccggcgacauccugcucaucaacucgaccgggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgucaaccgcaucaccuacggggccugcccccgguacgugaagcaguccacgcugaagcucgcgaccggcaugcgcaacgugcccgagaagcagacccgggggaucuucggcgccaucgccggguucaucgagaacggcugggagggcauggucgacgggugguacggcuuccgccaccagaacucggaggggcggggccaggccgccgaccugaaguccacccaggcggccaucgaccagaucaacgggaagcugaaccgccucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 12459 - RNA, 1701 nt, Artificial Sequence; identical to SEQ ID NO: 10129
  derived and/or modified CDS sequence (AUadapt) from InfluenzaA__AHZ40477__HA

SEQ ID NO: 12460 - RNA, 1701 nt, Artificial Sequence; identical to SEQ ID NO: 10305
  derived and/or modified CDS sequence (AUadapt) from InfluenzaA__AHZ40489__HA

SEQ ID NO: 12461 - RNA, 1701 nt, Artificial Sequence; identical to SEQ ID NO: 10128
  derived and/or modified CDS sequence (AUadapt) from InfluenzaA__AHZ40500__HA

SEQ ID NO: 12462 - RNA, 1701 nt, Artificial Sequence; identical to SEQ ID NO: 10128
  derived and/or modified CDS sequence (AUadapt) from InfluenzaA__AHZ40512__HA

SEQ ID NO: 12463 - RNA, 1701 nt, Artificial Sequence
  derived and/or modified CDS sequence (AUadapt) from InfluenzaA__AHZ40524__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagcggcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 12464 - RNA, 1701 nt, Artificial Sequence; identical to SEQ ID NO: 12015
  derived and/or modified CDS sequence (AUadapt) from InfluenzaA__AHZ40536__HA

SEQ ID NO: 12465 - RNA, 1701 nt, Artificial Sequence; identical to SEQ ID NO: 10128
  derived and/or modified CDS sequence (AUadapt) from InfluenzaA__AHZ40548__HA

SEQ ID NO: 12466 - RNA, 1701 nt, Artificial Sequence; identical to SEQ ID NO: 10103
  derived and/or modified CDS sequence (AUadapt) from InfluenzaA__AHZ40572__HA

SEQ ID NO: 12467 - RNA, 1701 nt, Artificial Sequence; identical to SEQ ID NO: 10103
  derived and/or modified CDS sequence (AUadapt) from InfluenzaA__AHZ40583__HA

SEQ ID NO: 12468 - RNA, 1701 nt, Artificial Sequence
  derived and/or modified CDS sequence (AUadapt) from InfluenzaA__AHZ40595__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacgacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcacgccggggcgaagggcuucuacaagaaccugaucuggcuggugaagaaggggaacagcuaccccaagcucuccaucucguacaucaacgacaagggcaaggaggugcugguccuguggggcauccaccaccccuccaccacggccgaccagcagucgcucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccaugaagcgcaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgccaucuacuccaccgcggccucgucccugguccugguggugagccucggcgccaucuccuucuggaugugcucgaacgggagccugcagugccggaucugcaucuga

SEQ ID NO: 12469 - RNA, 1701 nt, Artificial Sequence
  derived and/or modified CDS sequence (AUadapt) from InfluenzaA__AHZ40606__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugauggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 12470 - RNA, 1701 nt, Artificial Sequence; identical to SEQ ID NO: 10128
  derived and/or modified CDS sequence (AUadapt) from InfluenzaA__AHZ40618__HA

SEQ ID NO: 12471 - RNA, 1701 nt, Artificial Sequence; identical to SEQ ID NO: 10167
  derived and/or modified CDS sequence (AUadapt) from InfluenzaA__AHZ40626__HA

SEQ ID NO: 12472 - RNA, 1701 nt, Artificial Sequence; identical to SEQ ID NO: 10128
  derived and/or modified CDS sequence (AUadapt) from InfluenzaA__AHZ40638__HA

SEQ ID NO: 12473 - RNA, 1701 nt, Artificial Sequence; identical to SEQ ID NO: 10103
  derived and/or modified CDS sequence (AUadapt) from InfluenzaA__AHZ40650__HA

SEQ ID NO: 12474 - RNA, 1701 nt, Artificial Sequence
  derived and/or modified CDS sequence (AUadapt) from InfluenzaA__AHZ40662__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcggucgaaggcccacuccaacugcuaccccuacgacgugccggacuacgcgagccugcgcucccucgucgccucguccggcacgcuggaguucaacaacgagagcuucaacuggaccggggugacccagaacggcaccuccucggccugcauccggcgcuccaacaacucguucuucucccggcugaacuggcucacgcaccugaacuucaaguaccccgcccugaacgugaccauccccaacaacgagcaguucgacaagcucuacaucuggggcguccaccaccccgggaccgacaaggaccagaucuuccuguacgcgcaggccagcgggcgcaucaccguguccacgaagcggucgcagcagaccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggcgugccagaaggggaacauccgcugcaacaucugcaucuga

SEQ ID NO: 12475 - RNA, 1701 nt, Artificial Sequence; identical to SEQ ID NO: 10148
  derived and/or modified CDS sequence (AUadapt) from InfluenzaA__AHZ40674__HA

SEQ ID NO: 12476 - RNA, 1701 nt, Artificial Sequence; identical to SEQ ID NO: 10128
  derived and/or modified CDS sequence (AUadapt) from InfluenzaA__AHZ40686__HA

SEQ ID NO: 12477 - RNA, 1701 nt, Artificial Sequence; identical to SEQ ID NO: 10113
  derived and/or modified CDS sequence (AUadapt) from InfluenzaA__AHZ40698__HA

SEQ ID NO: 12478 - RNA, 1701 nt, Artificial Sequence; identical to SEQ ID NO: 10113
  derived and/or modified CDS sequence (AUadapt) from InfluenzaA__AHZ40710__HA

SEQ ID NO: 12479 - RNA, 1701 nt, Artificial Sequence; identical to SEQ ID NO: 162
  derived and/or modified CDS sequence (AUadapt) from InfluenzaA__AHZ40722__HA

SEQ ID NO: 12480 - RNA, 1701 nt, Artificial Sequence; identical to SEQ ID NO: 10136
  derived and/or modified CDS sequence (AUadapt) from InfluenzaA__AHZ40734__HA

SEQ ID NO: 12481 - RNA, 1701 nt, Artificial Sequence; identical to SEQ ID NO: 162
  derived and/or modified CDS sequence (AUadapt) from InfluenzaA__AHZ40746__HA

SEQ ID NO: 12482 - RNA, 1701 nt, Artificial Sequence; identical to SEQ ID NO: 12432
  derived and/or modified CDS sequence (AUadapt) from InfluenzaA__AHZ40758__HA

SEQ ID NO: 12483 - RNA, 1701 nt, Artificial Sequence; identical to SEQ ID NO: 53
  derived and/or modified CDS sequence (AUadapt) from InfluenzaA__AHZ40782__HA

SEQ ID NO: 12484 - RNA, 1701 nt, Artificial Sequence; identical to SEQ ID NO: 53
  derived and/or modified CDS sequence (AUadapt) from InfluenzaA__AHZ40793__HA

SEQ ID NO: 12485 - RNA, 1701 nt, Artificial Sequence; identical to SEQ ID NO: 53
  derived and/or modified CDS sequence (AUadapt) from InfluenzaA__AHZ40804__HA

SEQ ID NO: 12486 - RNA, 1701 nt, Artificial Sequence; identical to SEQ ID NO: 54
  derived and/or modified CDS sequence (AUadapt) from InfluenzaA__AHZ40815__HA

SEQ ID NO: 12487 - RNA, 1701 nt, Artificial Sequence
  derived and/or modified CDS sequence (AUadapt) from InfluenzaA__AHZ40826__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgaccagcaguccaucuaccagaacgccgacgccuacguguucgugggcagcucccgguacucgaagaaguucaagccggagaucgccauccgccccaagguccgggaccaggagggccgcaugaacuacuacuggacgcugguggagcccggggacaagaucaccuucgaggcgaccggcaaccugguggucccccgguacgccuucgccauggagcgcaacgccggguccggcaucaucaucagcgacaccccggugcacgacugcaacacgaccugccagacccccaagggcgccaucaacaccucccuccccuuccagaacauccaccccaucacgaucgggaagugcccgaaguacgucaagucgaccaagcugcggcuggcgaccggccuccgcaacauccccuccauccagagccgggggcuguucggcgccaucgccggguucaucgagggcggcuggaccgggaugguggacggcugguacggguaccaccaccagaacgagcagggcuccggguacgccgccgaccucaagucgacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccuggacaucuggacguacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcuggagagcacccgcaucuaccagauccucgcgaucuacuccaccguggccucgagccugguccugguggugucccucggggccaucucguucuggaugugcuccaacggcagccugcagugccggaucugcaucuga

SEQ ID NO: 12488 - RNA, 1701 nt, Artificial Sequence
  derived and/or modified CDS sequence (AUadapt) from InfluenzaA__AHZ40848__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaaggaggggaacuccuaccccaagcugagcaaguccuacaucaacgacaagggcaaggaggugcugguccucugggggauccaccaccccucgaccagcgccgagcagcagucccuguaccagaacgccgacgccuacguguucgugggcucgucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucucggacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagucgcggggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggccaucuacuccaccguggccucgagccugguccucguggugucccugggcgcgaucucguucuggaugugcuccaacggcagccugcagugccggaucugcaucuga

SEQ ID NO: 12489 - RNA, 1701 nt, Artificial Sequence
  derived and/or modified CDS sequence (AUadapt) from InfluenzaA__AHZ40881__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgagcagcagucccuguaccagaacgccgacgccuacguguucgugggcucgucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucucggacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagucgcggggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggccaucuacuccaccguggccucgagccugguccucguggugucccugggcgcgaucucguucuggaugugcuccaacggcagccugcagugccggaucugcaucuga

SEQ ID NO: 12490 - RNA, 1701 nt, Artificial Sequence; identical to SEQ ID NO: 12489
  derived and/or modified CDS sequence (AUadapt) from InfluenzaA__AHZ40892__HA

SEQ ID NO: 12491 - RNA, 1701 nt, Artificial Sequence; identical to SEQ ID NO: 12488
  derived and/or modified CDS sequence (AUadapt) from InfluenzaA__AHZ40914__HA

SEQ ID NO: 12492 - RNA, 1701 nt, Artificial Sequence; identical to SEQ ID NO: 12489
  derived and/or modified CDS sequence (AUadapt) from InfluenzaA__AHZ40925__HA

SEQ ID NO: 12493 - RNA, 1701 nt, Artificial Sequence
  derived and/or modified CDS sequence (AUadapt) from InfluenzaA__AHZ40936__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgagcagcagucccuguaccagaacgccgacgccuacguguucgugggcucgucccgguacagcaagaaguucaagccggagaucgccgcgcgccccaagguccgggaccaggccggccgcaugaacuacuacuggacgcugguggagcccggggacaagaucaccuucgaggccaccggcaaccucguggucccccgguacgccuucgccauggagcgcaacgcgggguccggcaucaucaucucggacaccccggugcacgacugcaacacgaccugccagacccccaagggcgccaucaacaccucccugcccuuccagaacauccaccccaucacgaucgggaagugcccgaaguacgucaagagcaccaagcugcggcucgccaccggccugcgcaacauccccuccauccagucgcgggggcuguucggcgccaucgccggguucaucgagggcggcuggaccgggaugguggacggcugguacggguaccaccaccagaacgagcagggcuccggguacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgcgaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggccucgagccugguccucguggugucccugggggcgaucucguucuggaugugcuccaacggcagccugcagugccggaucugcaucuga

SEQ ID NO: 12494 - RNA, 1701 nt, Artificial Sequence; identical to SEQ ID NO: 12488
  derived and/or modified CDS sequence (AUadapt) from InfluenzaA__AHZ40947__HA

SEQ ID NO: 12495 - RNA, 1701 nt, Artificial Sequence; identical to SEQ ID NO: 12489
  derived and/or modified CDS sequence (AUadapt) from InfluenzaA__AHZ40958__HA

SEQ ID NO: 12496 - RNA, 1701 nt, Artificial Sequence; identical to SEQ ID NO: 12493
  derived and/or modified CDS sequence (AUadapt) from InfluenzaA__AHZ40969__HA

SEQ ID NO: 12497 - RNA, 1701 nt, Artificial Sequence; identical to SEQ ID NO: 12493
  derived and/or modified CDS sequence (AUadapt) from InfluenzaA__AHZ40980__HA

SEQ ID NO: 12498 - RNA, 1701 nt, Artificial Sequence; identical to SEQ ID NO: 12493
  derived and/or modified CDS sequence (AUadapt) from InfluenzaA__AHZ40991__HA

SEQ ID NO: 12499 - RNA, 1701 nt, Artificial Sequence; identical to SEQ ID NO: 12493
  derived and/or modified CDS sequence (AUadapt) from InfluenzaA__AHZ41002__HA

SEQ ID NO: 12500 - RNA, 1701 nt, Artificial Sequence; identical to SEQ ID NO: 12493
  derived and/or modified CDS sequence (AUadapt) from InfluenzaA__AHZ41013__HA

SEQ ID NO: 12501 - RNA, 1701 nt, Artificial Sequence; identical to SEQ ID NO: 12489
  derived and/or modified CDS sequence (AUadapt) from InfluenzaA__AHZ41024__HA

SEQ ID NO: 12502 - RNA, 1701 nt, Artificial Sequence; identical to SEQ ID NO: 12489
  derived and/or modified CDS sequence (AUadapt) from InfluenzaA__AHZ41035__HA

SEQ ID NO: 12503 - RNA, 1701 nt, Artificial Sequence; identical to SEQ ID NO: 12489
  derived and/or modified CDS sequence (AUadapt) from InfluenzaA__AHZ41046__HA

SEQ ID NO: 12504 - RNA, 1701 nt, Artificial Sequence; identical to SEQ ID NO: 12489
  derived and/or modified CDS sequence (AUadapt) from InfluenzaA__AHZ41057__HA

SEQ ID NO: 12505 - RNA, 1701 nt, Artificial Sequence; identical to SEQ ID NO: 12489
  derived and/or modified CDS sequence (AUadapt) from InfluenzaA__AHZ41068__HA

SEQ ID NO: 12506 - RNA, 1701 nt, Artificial Sequence; identical to SEQ ID NO: 12493
  derived and/or modified CDS sequence (AUadapt) from InfluenzaA__AHZ41079__HA

SEQ ID NO: 12507 - RNA, 1701 nt, Artificial Sequence; identical to SEQ ID NO: 12489
  derived and/or modified CDS sequence (AUadapt) from InfluenzaA__AHZ41090__HA

SEQ ID NO: 12508 - RNA, 1701 nt, Artificial Sequence; identical to SEQ ID NO: 12493
  derived and/or modified CDS sequence (AUadapt) from InfluenzaA__AHZ41101__HA

SEQ ID NO: 12509 - RNA, 1701 nt, Artificial Sequence; identical to SEQ ID NO: 12489
  derived and/or modified CDS sequence (AUadapt) from InfluenzaA__AHZ41112__HA

SEQ ID NO: 12510 - RNA, 1701 nt, Artificial Sequence; identical to SEQ ID NO: 12489
  derived and/or modified CDS sequence (AUadapt) from InfluenzaA__AHZ41123__HA

SEQ ID NO: 12511 - RNA, 1701 nt, Artificial Sequence; identical to SEQ ID NO: 12489
  derived and/or modified CDS sequence (AUadapt) from InfluenzaA__AHZ41134__HA

SEQ ID NO: 12512 - RNA, 1701 nt, Artificial Sequence; identical to SEQ ID NO: 12489
  derived and/or modified CDS sequence (AUadapt) from InfluenzaA__AHZ41145__HA

SEQ ID NO: 12513 - RNA, 1701 nt, Artificial Sequence; identical to SEQ ID NO: 12489
  derived and/or modified CDS sequence (AUadapt) from InfluenzaA__AHZ41156__HA

SEQ ID NO: 12514 - RNA, 1701 nt, Artificial Sequence; identical to SEQ ID NO: 12489
  derived and/or modified CDS sequence (AUadapt) from InfluenzaA__AHZ41167__HA

SEQ ID NO: 12515 - RNA, 1701 nt, Artificial Sequence; identical to SEQ ID NO: 12489
  derived and/or modified CDS sequence (AUadapt) from InfluenzaA__AHZ41178__HA

SEQ ID NO: 12516 - RNA, 1701 nt, Artificial Sequence; identical to SEQ ID NO: 12489
  derived and/or modified CDS sequence (AUadapt) from InfluenzaA__AHZ41189__HA

SEQ ID NO: 12517 - RNA, 1701 nt, Artificial Sequence; identical to SEQ ID NO: 12488
  derived and/or modified CDS sequence (AUadapt) from InfluenzaA__AHZ41246__HA

SEQ ID NO: 12518 - RNA, 1701 nt, Artificial Sequence; identical to SEQ ID NO: 12493
  derived and/or modified CDS sequence (AUadapt) from InfluenzaA__AHZ41263__HA

SEQ ID NO: 12519 - RNA, 1701 nt, Artificial Sequence; identical to SEQ ID NO: 12489
  derived and/or modified CDS sequence (AUadapt) from InfluenzaA__AHZ41281__HA

SEQ ID NO: 12520 - RNA, 1701 nt, Artificial Sequence; identical to SEQ ID NO: 12489
  derived and/or modified CDS sequence (AUadapt) from InfluenzaA__AHZ41292__HA

SEQ ID NO: 12521 - RNA, 1701 nt, Artificial Sequence; identical to SEQ ID NO: 12488
  derived and/or modified CDS sequence (AUadapt) from InfluenzaA__AHZ41303__HA

SEQ ID NO: 12522 - RNA, 1701 nt, Artificial Sequence; identical to SEQ ID NO: 12488
  derived and/or modified CDS sequence (AUadapt) from InfluenzaA__AHZ41314__HA

SEQ ID NO: 12523 - RNA, 1701 nt, Artificial Sequence; identical to SEQ ID NO: 12488
  derived and/or modified CDS sequence (AUadapt) from InfluenzaA__AHZ41325__HA

SEQ ID NO: 12524 - RNA, 1701 nt, Artificial Sequence; identical to SEQ ID NO: 12488
  derived and/or modified CDS sequence (AUadapt) from InfluenzaA__AHZ41336__HA

SEQ ID NO: 12525 - RNA, 1701 nt, Artificial Sequence; identical to SEQ ID NO: 12488
  derived and/or modified CDS sequence (AUadapt) from InfluenzaA__AHZ41347__HA

SEQ ID NO: 12526 - RNA, 1701 nt, Artificial Sequence; identical to SEQ ID NO: 12489
  derived and/or modified CDS sequence (AUadapt) from InfluenzaA__AHZ41358__HA

SEQ ID NO: 12527 - RNA, 1701 nt, Artificial Sequence; identical to SEQ ID NO: 12489
  derived and/or modified CDS sequence (AUadapt) from InfluenzaA__AHZ41366__HA

SEQ ID NO: 12528 - RNA, 1701 nt, Artificial Sequence; identical to SEQ ID NO: 12493
  derived and/or modified CDS sequence (AUadapt) from InfluenzaA__AHZ41377__HA

SEQ ID NO: 12529 - RNA, 1701 nt, Artificial Sequence; identical to SEQ ID NO: 12489
  derived and/or modified CDS sequence (AUadapt) from InfluenzaA__AHZ41388__HA

SEQ ID NO: 12530 - RNA, 1701 nt, Artificial Sequence; identical to SEQ ID NO: 12493
  derived and/or modified CDS sequence (AUadapt) from InfluenzaA__AHZ41410__HA

SEQ ID NO: 12531 - RNA, 1701 nt, Artificial Sequence; identical to SEQ ID NO: 12489
  derived and/or modified CDS sequence (AUadapt) from InfluenzaA__AHZ41432__HA

SEQ ID NO: 12532 - RNA, 1701 nt, Artificial Sequence
  derived and/or modified CDS sequence (AUadapt) from InfluenzaA__AHZ41441__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaaggaggggaacuccuaccccaagcugagcaaguccuacaucaacgacaagggcaaggaggugcugguccucugggggauccaccaccccucgaccagcgccgagcagcagucccuguaccagaacgccgacgccuacguguucgugggcucgucccgguacagcaagaaguucaagccggagaucgccgcgcgccccaagguccgggaccaggccggccgcaugaacuacuacuggacgcugguggagcccggggacaagaucaccuucgaggccaccggcaaccucguggucccccgguacgccuucgccauggagcgcaacgcgggguccggcaucaucaucucggacaccccggugcacgacugcaacacgaccugccagacccccaagggcgccaucaacaccucccugcccuuccagaacauccaccccaucacgaucgggaagugcccgaaguacgucaagagcaccaagcugcggcucgccaccggccugcgcaacauccccuccauccagucgcgggggcuguucggcgccaucgccggguucaucgagggcggcuggaccgggaugguggacggcugguacggguaccaccaccagaacgagcagggcuccggguacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgcgaaggagaucgggaacggcugcuucgaguucuaccacaagugcgacaacacgugcauggagucggucaagaacgggaccuacgacuaccccaaguacuccgaggaggccaagcugaaccgggaggagaucgacggcgugaagcucgagagcacccgcaucuaccagauccuggccaucuacuccaccguggccucgagccugguccucguggugucccugggggcgaucucguucuggaugugcuccaacggcagccugcagugccggaucugcaucuga

SEQ ID NO: 12533 - RNA, 1701 nt, Artificial Sequence; identical to SEQ ID NO: 12488
  derived and/or modified CDS sequence (AUadapt) from InfluenzaA__AHZ41452__HA

SEQ ID NO: 12534 - RNA, 1701 nt, Artificial Sequence
  derived and/or modified CDS sequence (AUadapt) from InfluenzaA__AHZ41463__HA
augaaggccauccuggugguccuccuguacaccuucgccaccgcgaacgccgacacgcugugcaucggcuaccacgccaacaacucgaccgacaccguguacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgagcagcagucccuguaccagaacgccgacgccuacguguucgugggcagcucccgguacucgaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagucgaccaagcugcggcucgccaccgggcugcgcaacauccccuccauccagagccggggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggccaucuacuccaccguggccucgagccugguccucguggugucccugggcgcgaucucguucuggaugugcuccaacggcagccugcagugccggaucugcaucuga

SEQ ID NO: 12535 - RNA, 1701 nt, Artificial Sequence; identical to SEQ ID NO: 12488
  derived and/or modified CDS sequence (AUadapt) from InfluenzaA__AHZ41473__HA

SEQ ID NO: 12536 - RNA, 1701 nt, Artificial Sequence; identical to SEQ ID NO: 12488
  derived and/or modified CDS sequence (AUadapt) from InfluenzaA__AHZ41484__HA

SEQ ID NO: 12537 - RNA, 1701 nt, Artificial Sequence; identical to SEQ ID NO: 12493
  derived and/or modified CDS sequence (AUadapt) from InfluenzaA__AHZ41495__HA

SEQ ID NO: 12538 - RNA, 1701 nt, Artificial Sequence; identical to SEQ ID NO: 12488
  derived and/or modified CDS sequence (AUadapt) from InfluenzaA__AHZ41506__HA

SEQ ID NO: 12539 - RNA, 1701 nt, Artificial Sequence
  derived and/or modified CDS sequence (AUadapt) from InfluenzaA__AHZ41517__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaagaaggggaacuccuaccccaagcugagcgaguccuacaucaacgacaagggcaaggaggugcugguccucugggggauccaccaccccucgaccagcgccgagcagcagucccuguaccagaacgccgacgccuacguguucgugggcucgucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucucggacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagucgcggggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggccaucuacuccaccguggccucgagccugguccucguggugucccugggcgcgaucucguucuggaugugcuccaacggcagccugcagugccggaucugcaucuga

SEQ ID NO: 12540 - RNA, 1701 nt, Artificial Sequence
  derived and/or modified CDS sequence (AUadapt) from InfluenzaA__AHZ41528__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaagaaggggaacuccuaccccaagcugagcgaguccuacaucaacgacaagggcaaggaggugcugguccucugggggauccaccaccccucgaccagcgccgaccagcagucccuguaccagaacgccgacgccuacguguucgugggcucgucccgguacagcaagaaguucaagccggagaucgccgcgcgccccaagguccggggccaggccgggcgcaugaacuacuacuggacgcugguggagcccggcgacaagaucaccuucgaggccaccgggaaccucguggucccccgguacgccuucgccauggagcgcaacgcgggcuccggcaucaucaucucggacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagucgcggggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggccaucuacuccaccguggccucgagccugguccucguggugucccugggcgcgaucucguucuggaugugcuccaacggcagccugcagugccggaucugcaucuga

SEQ ID NO: 12541 - RNA, 1701 nt, Artificial Sequence; identical to SEQ ID NO: 12493
  derived and/or modified CDS sequence (AUadapt) from InfluenzaA__AHZ41539__HA

SEQ ID NO: 12542 - RNA, 1701 nt, Artificial Sequence; identical to SEQ ID NO: 12488
  derived and/or modified CDS sequence (AUadapt) from InfluenzaA__AHZ41550__HA

SEQ ID NO: 12543 - RNA, 1701 nt, Artificial Sequence; identical to SEQ ID NO: 12489
  derived and/or modified CDS sequence (AUadapt) from InfluenzaA__AHZ41561__HA

SEQ ID NO: 12544 - RNA, 1701 nt, Artificial Sequence
  derived and/or modified CDS sequence (AUadapt) from InfluenzaA__AHZ41572__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaagaccuccucguggccgaaccacgacuccaacaagggggucaccgccgccugcccccacgccggcgccaagucguucuacaagaaccugaucuggcucgugaagaaggggaacuccuaccccaagcugagcaaguccuacaucaacgacaagggcaaggaggugcugguccucugggggauccaccaccccucgaccagcgccgagcagcagucccuguaccagaacgccgacgccuacguguucgugggcucgucccgguacagcaagaaguucaagccggagaucgccgcgcgccccaagguccggggccaggccgggcgcaugaacuacuacuggacgcugguggagcccggcgacgagaucaccuucgaggccaccgggaaccucguggucccccgguacgccuucgccauggagcgcaacgcgggcuccggcaucaucaucucggacaccccggugcacgacugcaacacgaccugccagacccccaagggggccaucaacaccucccugcccuuccagaacauccaccccaucacgaucggcaagugcccgaaguacgucaagagcaccaagcugcggcucgccaccgggcugcgcaacauccccuccauccagucgcggggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgggaggagaucgacggggugaagcucgagagcacccgcaucuaccagauccuggccaucuacuccaccguggccucgagccugguccucguggugucccugggcgcgaucucguucuggaugugcuccaacggcagccugcagugccggaucugcaucuga

SEQ ID NO: 12545 - RNA, 1701 nt, Artificial Sequence; identical to SEQ ID NO: 12493
  derived and/or modified CDS sequence (AUadapt) from InfluenzaA__AHZ41583__HA

SEQ ID NO: 12546 - RNA, 1701 nt, Artificial Sequence; identical to SEQ ID NO: 12488
  derived and/or modified CDS sequence (AUadapt) from InfluenzaA__AHZ41594__HA

SEQ ID NO: 12547 - RNA, 1701 nt, Artificial Sequence
  derived and/or modified CDS sequence (AUadapt) from InfluenzaA__AHZ41605__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagacccccuccagcgacaacggcacgugcuaccccggcgacuucaucgacuacgaggagcuccgggagcagcuguccucgguguccagcuucgagcgcuucgagaucuuccccaacaccuccucguggccgaaccacgacuccaacaagggggucaccgccgccugcccccacgccggcgccaagagcuucuacaagaaccugaucuggcucgugaagaaggggaacuccuaccccaagcugucgaaguccuacaucaacgacaagggcaaggaggugcugguccucugggggauccaccaccccagcaccucggccgagcagcagucccuguaccagaacgccgacgccuacguguucgugggcagcucccgguacucgaagaaguucaagccggagaucgccgcgcgccccaaggucaugggccaggccgggcggaugaacuacuacuggacgcugguggagcccggcgacaagaucaccuucgaggccaccgggaaccucguggucccccgcuacgccuucgccauggagcggaacgcgggcuccggcaucaucaucagcgacaccccggugcacgacugcaacacgaccugccagacccccaagggggccaucaacaccucccugcccuuccagaacauccaccccaucacgaucggcaagugcccgaaguacgucaagucgaccaagcugcgccucgccaccgggcugcggaacauccccuccauccagagccgcggccuguucggggccaucgccggcuucaucgagggcggguggaccggcaugguggacgggugguacggcuaccaccaccagaacgagcagggguccggcuacgcggccgaccucaagucgacgcagaacgccaucgacgagaucaccaacaaggugaacuccgugaucgagaagaugaacacccaguucaccgccgucggcaaggaguucaaccaccuggagaagcggaucgagaaccugaacaagaagguggacgacggguuccucgacaucuggacguacaacgccgagcugcugguccuccuggagaacgagcgcacccuggacuaccacgacagcaacgugaagaaccucuacgagaaggugcggucccagcugaagaacaacgcgaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcucgagagcacccggaucuaccagauccuggccaucuacuccaccguggccucgagccugguccucguggugucccugggcgcgaucucguucuggaugugcuccaacggcagccugcagugccgcaucugcaucuga

SEQ ID NO: 12548 - RNA, 1701 nt, Artificial Sequence; identical to SEQ ID NO: 12488
  derived and/or modified CDS sequence (AUadapt) from InfluenzaA__AHZ41616__HA

SEQ ID NO: 12549 - RNA, 1701 nt, Artificial Sequence; identical to SEQ ID NO: 12493
  derived and/or modified CDS sequence (AUadapt) from InfluenzaA__AHZ41627__HA

SEQ ID NO: 12550 - RNA, 1701 nt, Artificial Sequence; identical to SEQ ID NO: 12493
  derived and/or modified CDS sequence (AUadapt) from InfluenzaA__AHZ41638__HA

SEQ ID NO: 12551 - RNA, 1701 nt, Artificial Sequence; identical to SEQ ID NO: 12489
  derived and/or modified CDS sequence (AUadapt) from InfluenzaA__AHZ41649__HA

SEQ ID NO: 12552 - RNA, 1701 nt, Artificial Sequence; identical to SEQ ID NO: 12489
  derived and/or modified CDS sequence (AUadapt) from InfluenzaA__AHZ41660__HA

SEQ ID NO: 12553 - RNA, 1701 nt, Artificial Sequence; identical to SEQ ID NO: 12493
  derived and/or modified CDS sequence (AUadapt) from InfluenzaA__AHZ41671__HA

SEQ ID NO: 12554 - RNA, 1701 nt, Artificial Sequence; identical to SEQ ID NO: 12493
  derived and/or modified CDS sequence (AUadapt) from InfluenzaA__AHZ41682__HA

SEQ ID NO: 12555 - RNA, 1701 nt, Artificial Sequence; identical to SEQ ID NO: 12493
  derived and/or modified CDS sequence (AUadapt) from InfluenzaA__AHZ41693__HA

SEQ ID NO: 12556 - RNA, 1701 nt, Artificial Sequence; identical to SEQ ID NO: 12493
  derived and/or modified CDS sequence (AUadapt) from InfluenzaA__AHZ41704__HA

SEQ ID NO: 12557 - RNA, 1701 nt, Artificial Sequence; identical to SEQ ID NO: 12493
  derived and/or modified CDS sequence (AUadapt) from InfluenzaA__AHZ41715__HA

SEQ ID NO: 12558 - RNA, 1701 nt, Artificial Sequence; identical to SEQ ID NO: 12493
  derived and/or modified CDS sequence (AUadapt) from InfluenzaA__AHZ41726__HA

SEQ ID NO: 12559 - RNA, 1701 nt, Artificial Sequence; identical to SEQ ID NO: 12493
  derived and/or modified CDS sequence (AUadapt) from InfluenzaA__AHZ41737__HA

SEQ ID NO: 12560 - RNA, 1701 nt, Artificial Sequence; identical to SEQ ID NO: 12493
  derived and/or modified CDS sequence (AUadapt) from InfluenzaA__AHZ41748__HA

SEQ ID NO: 12561 - RNA, 1701 nt, Artificial Sequence; identical to SEQ ID NO: 12493
  derived and/or modified CDS sequence (AUadapt) from InfluenzaA__AHZ41759__HA

SEQ ID NO: 12562 - RNA, 1701 nt, Artificial Sequence; identical to SEQ ID NO: 10320
  derived and/or modified CDS sequence (AUadapt) from InfluenzaA__AHZ42561__HA

SEQ ID NO: 12563 - RNA, 1701 nt, Artificial Sequence
  derived and/or modified CDS sequence (AUadapt) from InfluenzaA__AHZ42572__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagauggacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12564 - RNA, 1701 nt, Artificial Sequence; identical to SEQ ID NO: 12031
  derived and/or modified CDS sequence (AUadapt) from InfluenzaA__AHZ42584__HA

SEQ ID NO: 12565 - RNA, 1701 nt, Artificial Sequence; identical to SEQ ID NO: 10128
  derived and/or modified CDS sequence (AUadapt) from InfluenzaA__AHZ42596__HA

SEQ ID NO: 12566 - RNA, 1701 nt, Artificial Sequence; identical to SEQ ID NO: 10305
  derived and/or modified CDS sequence (AUadapt) from InfluenzaA__AHZ42608__HA

SEQ ID NO: 12567 - RNA, 1701 nt, Artificial Sequence; identical to SEQ ID NO: 10128
  derived and/or modified CDS sequence (AUadapt) from InfluenzaA__AHZ42619__HA

SEQ ID NO: 12568 - RNA, 1701 nt, Artificial Sequence
  derived and/or modified CDS sequence (AUadapt) from InfluenzaA__AHZ42631__HA
augaagaccaucaucgcccugucguacauccucugccugguguucgcccagaagcugcccggcaacuacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12569 - RNA, 1701 nt, Artificial Sequence
  derived and/or modified CDS sequence (AUadapt) from InfluenzaA__AHZ42643__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaaggccuccucguggcccaaccacgacuccaacaagggcgucaccgccgccugcccgcacgcgggggccaagggcuucuacaagaaccugaucuggcuggugaagaaggggaacagcuaccccaagcucuccaucucguacaucaacgacaagggcaaggaggugcugguccuguggggcauccaccaccccuccaccaccgccgaccagcagucgcucuaccagaacgccgacacguacguguucguggggaccagccgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucgccauggagcgcaacgccggcucggggaucaucaucuccgacacccccgugcacgacugcaacacgaccugccagaccccgaagggcgccaucaacaccucgcuccccuuccagaacauccaccccaucaccaucgggaagugccccaaguacgugaaguccaccaagcugcggcuggcgacgggccuccgcaacgucccgagcauccagucccgggggcuguucggcgccaucgccggcuucaucgagggcggguggaccgggaugguggacggcugguacggguaccaccaccagaacgagcagggcucgggcuacgccgccgaccugaaguccacccagaacgcgaucgacaagaucaccaacaaggugaacucggucaucgagaagaugaacacgcaguucaccgccguggggaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcuggagucgacccgcaucuaccagauccucgcgaucuacuccaccgccgccucgucccugguccugguggugagccucggcgccaucuccuucuggaugugcucgaacgggagccugcagugccggaucugcaucuga

SEQ ID NO: 12570 - RNA, 1701 nt, Artificial Sequence; identical to SEQ ID NO: 10128
  derived and/or modified CDS sequence (AUadapt) from InfluenzaA__AHZ42654__HA

SEQ ID NO: 12571 - RNA, 1701 nt, Artificial Sequence; identical to SEQ ID NO: 10103
  derived and/or modified CDS sequence (AUadapt) from InfluenzaA__AHZ42666__HA

SEQ ID NO: 12572 - RNA, 1701 nt, Artificial Sequence; identical to SEQ ID NO: 10103
  derived and/or modified CDS sequence (AUadapt) from InfluenzaA__AHZ42678__HA

SEQ ID NO: 12573 - RNA, 1701 nt, Artificial Sequence
  derived and/or modified CDS sequence (AUadapt) from InfluenzaA__AHZ42690__HA
augaaggccauccuggugguccuccuguacaccuacgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacgaccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucacguucgaggccaccggcaaccucguggugccccgguacgcguucgccauggagcgcaacgccgggagcggcaucaucaucuccgacacccccguccacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagucgacccgcaucuaccagauccuggccaucuacuccaccguggcgucgucccugguccucguggugagccugggggccaucucguucuggaugugcuccaacggcagccugcagugccggaucugcaucuga

SEQ ID NO: 12574 - RNA, 1701 nt, Artificial Sequence; identical to SEQ ID NO: 10128
  derived and/or modified CDS sequence (AUadapt) from InfluenzaA__AHZ42701__HA

SEQ ID NO: 12575 - RNA, 1701 nt, Artificial Sequence; identical to SEQ ID NO: 10103
  derived and/or modified CDS sequence (AUadapt) from InfluenzaA__AHZ42713__HA

SEQ ID NO: 12576 - RNA, 1701 nt, Artificial Sequence
  derived and/or modified CDS sequence (AUadapt) from InfluenzaA__AHZ42725__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccggaacgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12577 - RNA, 1701 nt, Artificial Sequence
  derived and/or modified CDS sequence (AUadapt) from InfluenzaA__AHZ42737__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucgccauggagcgcaacgccgagucggggaucaucaucuccgacacccccguccacgacugcaacacgaccugccagaccccggagggcgccaucaacaccagccugcccuuccagaacauccaccccaucaccaucggcaagugccccaaguacgugaaguccaccaagcugcggcucgcgacggggcugcgcaacgugccgucgauccagucccggggccuguucggggccaucgccggcuucaucgagggcggguggaccggcauggucgacgggugguacggcuaccaccaccagaacgagcaggggagcggcuacgccgccgaccucaaguccacccagaacgcgaucgacaagaucaccaacaaggugaacucggugaucgagaagaugaacacgcaguucaccgccgucgggaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucggcaacgggugcuucgaguucuaccacaagugcgacaacacgugcauggagucggucaagaacggcaccuacgacuaccccaaguacuccgaggaggccaagcugaaccgggagaagaucgacggggugaagcucgagagcacccgcaucuaccagauccuggcgaucuacuccaccguggccucgucccugguccucguggugagccugggcgccaucucguucuggaugugcuccaacgggagccugcagugccggaucugcaucuga

SEQ ID NO: 12578 - RNA, 1701 nt, Artificial Sequence; identical to SEQ ID NO: 10128
  derived and/or modified CDS sequence (AUadapt) from InfluenzaA__AHZ42748__HA

SEQ ID NO: 12579 - RNA, 1701 nt, Artificial Sequence; identical to SEQ ID NO: 10148
  derived and/or modified CDS sequence (AUadapt) from InfluenzaA__AHZ42760__HA

SEQ ID NO: 12580 - RNA, 1701 nt, Artificial Sequence
  derived and/or modified CDS sequence (AUadapt) from InfluenzaA__AHZ42772__HA
augaagaccaucaucgcccugucguacauccucugccugguguucgcccaggagcugcccggcaacgacgacuccaccgcgacgcucugccuggggcaccacgccgucccgaacggcaccaucgugaagaccaucaccaacgaccgcaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcggucgaaggcccacuccaacugcuaccccuacgacgugccggacuacgcgagccugcgcucccucgucgccucguccggcacgcuggaguucaacaacgagagcuucaacuggaccggggugacccagaacggcaccuccucggccugcauccggcgcuccaacaacucguucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcagaccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacucggaggggcgcggccaggccgcggaccugaaguccacccaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacucggagaugaacaagcuguucgagaagaccaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaaggagguggagcugaaguccggguacaaggacuggauccuguggaucuccuucgccaucagcugcuuccuccugugcgucgcccugcucggcuucaucaugugggcgugccagaagggcaacauccgcugcaacaucugcaucuga

SEQ ID NO: 12581 - RNA, 1701 nt, Artificial Sequence; identical to SEQ ID NO: 10128
  derived and/or modified CDS sequence (AUadapt) from InfluenzaA__AHZ42784__HA

SEQ ID NO: 12582 - RNA, 1701 nt, Artificial Sequence; identical to SEQ ID NO: 10103
  derived and/or modified CDS sequence (AUadapt) from InfluenzaA__AHZ42796__HA

SEQ ID NO: 12583 - RNA, 1701 nt, Artificial Sequence; identical to SEQ ID NO: 10103
  derived and/or modified CDS sequence (AUadapt) from InfluenzaA__AHZ42808__HA

SEQ ID NO: 12584 - RNA, 1701 nt, Artificial Sequence; identical to SEQ ID NO: 12577
  derived and/or modified CDS sequence (AUadapt) from InfluenzaA__AHZ42820__HA

SEQ ID NO: 12585 - RNA, 1701 nt, Artificial Sequence; identical to SEQ ID NO: 10712
  derived and/or modified CDS sequence (AUadapt) from InfluenzaA__AHZ42831__HA

SEQ ID NO: 12586 - RNA, 1701 nt, Artificial Sequence
  derived and/or modified CDS sequence (AUadapt) from InfluenzaA__AHZ42843__HA
augaagaccaucaucgcccugucguacauccucugccugguguucgcccagaagcugcccggcaacgacaacuccaccgcgacgcucugccuggggcaccacgccgucccgaacggcaccauggugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12587 - RNA, 1701 nt, Artificial Sequence
  derived and/or modified CDS sequence (AUadapt) from InfluenzaA__AHZ42855__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacaugacgaugcccaacaacgagcaguucgacaagcucuacaucuggggcgugcaccaccccgggaccgacaaggaccagaucuuccuguacgcgcagagcuccgggcgcaucaccgucagcaccaagcggucgcagcaggccgugaucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgucaaccggaucaccuacggggccugcccccgcuacgugaagcaguccacgcugaagcucgcgaccggcaugcggaacgugcccgagaagcagacccgcgggaucuucggcgccaucgccggguucaucgagaacggcugggagggcauggucgacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 12588 - RNA, 1701 nt, Artificial Sequence
  derived and/or modified CDS sequence (AUadapt) from InfluenzaA__AHZ42867__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacccuggaguucaacaacgaguccuucaacugggccggggugacgcagaacggcaccucguccgccugcauccgcgggagcaacuccucguucuucucccggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcgaguacaaggacuggauccuguggaucuccuucgccaucagcugcuuccugcugugcguggcccugcucggcuucaucaugugggcgugccagaaggggaacauccgcugcaacaucugcaucuga

SEQ ID NO: 12589 - RNA, 1701 nt, Artificial Sequence; identical to SEQ ID NO: 10103
  derived and/or modified CDS sequence (AUadapt) from InfluenzaA__AHZ42879__HA

SEQ ID NO: 12590 - RNA, 1701 nt, Artificial Sequence
  derived and/or modified CDS sequence (AUadapt) from InfluenzaA__AHZ42891__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcuccugcuaccccuacgacgugccggacuacgcgucgcugcgcucccucgucgccagcuccggcacccuggaguucaacaacgagucguucaacugggccggggugacgcagaacggcaccuccagcgccugcauccggcgcuccaacagcuccuucuucucgcggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcgggcgcaucaccgugucgaccaagcggucccagcaggccgugaucccgaacaucggcagccgcccccggauccgcaacauccccucccggaucucgaucuacuggaccaucgucaagcccggcgacauccugcucaucaacuccacggggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggcgugcccccgcuacgugaagcagagcacccugaagcucgccacgggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagucgacccaggccgccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgcggaggacauggggaacggcugcuucaagaucuaccacaagugcgacaacgccugcaucgggucgauccggaacggcacguacgaccacgacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggcgugccagaaggggaacauccgcugcaacaucugcaucuga

SEQ ID NO: 12591 - RNA, 1701 nt, Artificial Sequence
  derived and/or modified CDS sequence (AUadapt) from InfluenzaA__AHZ42903__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcaacuccucguucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 12592 - RNA, 1701 nt, Artificial Sequence; identical to SEQ ID NO: 10080
  derived and/or modified CDS sequence (AUadapt) from InfluenzaA__AHZ42915__HA

SEQ ID NO: 12593 - RNA, 1683 nt, Artificial Sequence; identical to SEQ ID NO: 86
  derived and/or modified CDS sequence (AUadapt) from InfluenzaA__AHZ59747__HA

SEQ ID NO: 12594 - RNA, 1683 nt, Artificial Sequence
  derived and/or modified CDS sequence (AUadapt) from InfluenzaA__AHZ59759__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaauuuagcgccgaccugaucaucgagcgccgggagggguccgacgugugcuaccccggcaaguucgugaacgaggaggcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaauacggacaacgcggccuucccgcagaugaccaaauccuacaagaacacccgcaagagccccgcccucaucgucuggggcauccaccacuccgugagcaccgccgagcagacgaagcuguauggguccggcaacaagcuggugaccgucggcagcuccaacuaccagcagagcuucgugcccucccccggggcccggccccaggugaacggccucagcgggcggaucgauuuccacuggcugaugcugaaccccaacgacaccgucaccuucagcuucaacggcgcguuuaucgcccccgaccgcgccuccuuccuccggggcaagagcauggggauccaguccggcguccaaguggacgccaacugcgagggggacugcuaucacagcggcgggacgaucaucuccaaccugcccuuccagaacaucgacagccgcgccgugggcaagugcccgcgguaugugaagcagcgcucccugcuccuggcgaccgggaugaagaacgugcccgagauccccaagggccggggccuguucggggccaucgccggcuucaucgagaacgggugggagggccucaucgacgggugguacggcuuccgccaccagaacgcccagggcgaagggaccgccgcggauuacaagagcacccaguccgccaucgaccagaucacgggcaagcugaaccggcugaucgagaagaccaaccagcaguucgagcucaucgacaacgaguuuaacgaggucgaaaagcagaucgggaacgugaucaacuggacccgcgacagcaucaccgaggugugguccuacaacgccgagcugcuggucgccauggagaaccagcacacgaucgaucucgccgacagcgagauggacaagcuguacgagcgcgugaagcggcagcugcgcgagaacgcggaagaggacggcaccggcugcuucgagaucuuucacaagugcgacgacgacugcauggccuccauccggaacaacaccuacgaucacagcaagucccgcgaggaggccaugcagaaccggauccagaucgaccccgucaagcucagcuccggguacaaggacgugauccugugguucaguuucggcgccuccugcuucauccugcucgcgaucgugauggggcuggucuucaucugcgugaagaacggcaacaugcgcugcaccaucugcaucuga

SEQ ID NO: 12595 - RNA, 1683 nt, Artificial Sequence
  derived and/or modified CDS sequence (AUadapt) from InfluenzaA__AHZ59771__HA
augaauacccaaauccugguguucgcccucaucgccaucauccccaccaacgcggacaagaucugccugggccaccacgccgucagcaaugggacgaaggugaacacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuucucgaguucagcgccgaccugaucaucgagcgccgggagggguccgacgugugcuaccccggcaaguucgugaacgaggaagcccugcgccagauccuccgggagagugggggcaucgacaaggaggcgaugggguucaccuacuccggcauccgcaccaacggcgccaccagcgccugccggcgcuccgggagcuccuucuaugccgagaugaaguggcugcugagcaacacggacaacgcggccuucccgcagaugaccaaguccuacaagaacacccgcaagagccccgcccucaucgucuggggcauccaucacuccgugagcaccgccgagcagacgaagcuguacggguccggcaacaagcuggugaccgucggcagcuccaacuaccagcagagcuuugugcccucccccggggcccggccccaggugaacggccaaagcgggcggaucgacuuccacuggcucaugcugaaccccaacgacaccgucaccuuuagcuucaacggcgcguucaucgcccccgaccgcgccuccuuccugcggggcaagagcauggggauccaguccggcguccagguggacgccaauugcgagggggacugcuaccacagcggcgggacgaucaucuccaaccuccccuuccagaauaucgacagccgcgccgugggcaagugcccgcgguacgugaagcagcgcucccugcugcucgcgaccgggaugaagaacgugcccgagauccccaagggccggggccuguucggggccaucgccggcuucaucgagaacgggugggagggccugaucgaugggugguacggcuuccgccaccagaacgcccagggcgaggggaccgccgcggacuacaagagcacccaauccgccaucgaccagaucacgggcaagcucaaucggcugaucgagaagaccaaccagcaguucgagcugaucgacaacgaguucaacgaggucgagaagcagaucgggaacgugaucaacuggacccgcgauagcaucaccgaggugugguccuacaacgccgagcuccuggucgccauggagaaccagcacacgaucgaccuggccgacagcgagauggauaaacucuacgagcgcgugaagcggcagcugcgcgagaacgcggaggaggacggcaccggcugcuucgagaucuuccacaagugcgaugacgacugcauggccuccauccggaacaacaccuacgaccacaguaaguaccgcgaggaggccaugcagaaccggauccagaucgaccccgucaagcuguccagcggguacaaggacgugauccucugguucuccuucggcgccaguugcuucauccugcuggcgaucgugauggggcucgucuucaucugcgugaagaacggcaacaugcgcugcaccaucugcaucuga

SEQ ID NO: 12596 - RNA, 1683 nt, Artificial Sequence; identical to SEQ ID NO: 233
  derived and/or modified CDS sequence (AUadapt) from InfluenzaA__AHZ59795__HA

SEQ ID NO: 12597 - RNA, 1683 nt, Artificial Sequence; identical to SEQ ID NO: 233
  derived and/or modified CDS sequence (AUadapt) from InfluenzaA__AHZ59807__HA

SEQ ID NO: 12598 - RNA, 1683 nt, Artificial Sequence; identical to SEQ ID NO: 233
  derived and/or modified CDS sequence (AUadapt) from InfluenzaA__AHZ59819__HA

SEQ ID NO: 12599 - RNA, 1683 nt, Artificial Sequence; identical to SEQ ID NO: 86
  derived and/or modified CDS sequence (AUadapt) from InfluenzaA__AHZ59831__HA

SEQ ID NO: 12600 - RNA, 1683 nt, Artificial Sequence; identical to SEQ ID NO: 86
  derived and/or modified CDS sequence (AUadapt) from InfluenzaA__AHZ59843__HA

SEQ ID NO: 12601 - RNA, 1683 nt, Artificial Sequence; identical to SEQ ID NO: 86
  derived and/or modified CDS sequence (AUadapt) from InfluenzaA__AHZ59855__HA

SEQ ID NO: 12602 - RNA, 1683 nt, Artificial Sequence; identical to SEQ ID NO: 12595
  derived and/or modified CDS sequence (AUadapt) from InfluenzaA__AHZ59867__HA

SEQ ID NO: 12603 - RNA, 1683 nt, Artificial Sequence; identical to SEQ ID NO: 86
  derived and/or modified CDS sequence (AUadapt) from InfluenzaA__AHZ59879__HA

SEQ ID NO: 12604 - RNA, 1683 nt, Artificial Sequence; identical to SEQ ID NO: 12595
  derived and/or modified CDS sequence (AUadapt) from InfluenzaA__AHZ59915__HA

SEQ ID NO: 12605 - RNA, 1683 nt, Artificial Sequence; identical to SEQ ID NO: 86
  derived and/or modified CDS sequence (AUadapt) from InfluenzaA__AHZ59927__HA

SEQ ID NO: 12606 - RNA, 1683 nt, Artificial Sequence; identical to SEQ ID NO: 12595
  derived and/or modified CDS sequence (AUadapt) from InfluenzaA__AHZ59939__HA

SEQ ID NO: 12607 - RNA, 1683 nt, Artificial Sequence; identical to SEQ ID NO: 86
  derived and/or modified CDS sequence (AUadapt) from InfluenzaA__AHZ59951__HA

SEQ ID NO: 12608 - RNA, 1683 nt, Artificial Sequence; identical to SEQ ID NO: 86
  derived and/or modified CDS sequence (AUadapt) from InfluenzaA__AHZ59963__HA

SEQ ID NO: 12609 - RNA, 1683 nt, Artificial Sequence; identical to SEQ ID NO: 86
  derived and/or modified CDS sequence (AUadapt) from InfluenzaA__AHZ59988__HA

SEQ ID NO: 12610 - RNA, 1683 nt, Artificial Sequence; identical to SEQ ID NO: 86
  derived and/or modified CDS sequence (AUadapt) from InfluenzaA__AHZ60000__HA

SEQ ID NO: 12611 - RNA, 1683 nt, Artificial Sequence; identical to SEQ ID NO: 86
  derived and/or modified CDS sequence (AUadapt) from InfluenzaA__AHZ60012__HA

SEQ ID NO: 12612 - RNA, 1683 nt, Artificial Sequence; identical to SEQ ID NO: 86
  derived and/or modified CDS sequence (AUadapt) from InfluenzaA__AHZ60024__HA

SEQ ID NO: 12613 - RNA, 1683 nt, Artificial Sequence; identical to SEQ ID NO: 233
  derived and/or modified CDS sequence (AUadapt) from InfluenzaA__AHZ60036__HA

SEQ ID NO: 12614 - RNA, 1683 nt, Artificial Sequence; identical to SEQ ID NO: 233
  derived and/or modified CDS sequence (AUadapt) from InfluenzaA__AHZ60048__HA

SEQ ID NO: 12615 - RNA, 1683 nt, Artificial Sequence; identical to SEQ ID NO: 233
  derived and/or modified CDS sequence (AUadapt) from InfluenzaA__AHZ60060__HA

SEQ ID NO: 12616 - RNA, 1683 nt, Artificial Sequence; identical to SEQ ID NO: 233
  derived and/or modified CDS sequence (AUadapt) from InfluenzaA__AHZ60072__HA

SEQ ID NO: 12617 - RNA, 1683 nt, Artificial Sequence; identical to SEQ ID NO: 233
  derived and/or modified CDS sequence (AUadapt) from InfluenzaA__AHZ60084__HA

SEQ ID NO: 12618 - RNA, 1683 nt, Artificial Sequence
  derived and/or modified CDS sequence (AUadapt) from InfluenzaA__AHZ60096__HA
augaauacccaaauccugguguucgcccucaucgccaucauccccaccaacgcggacaagaucugccugggccaccacgccgucagcaacgggacgaaggugaauacccugaccgagcgcggcguggaggucgugaacgccaccgagacgguggagcggaccaacaucccgcgcaucugcuccaaggggaagcggaccgucgaccucggccagugcgggcugcugggcaccaucacgggcccgccccagugcgaccaguuccucgaauucagugccgaccugaucaucgagcgccgggagggguccgacgugugcuaccccggcaaguucgugaacgaggaggcccugcgccagauccuccgggagagcgggggcaucgacaaggaggcgaugggguuuaccuacuccggcauccgcaccaacggcgccaccagcgccugccggcgcuccgggagcuccuucuacgccgagaugaaguggcugcugagcaacacggaugacgcggccuucccgcagaugaccaaauccuacaagaacacccgcaagagccccgcccucaucgucuggggcauccaccacuccgugagcaccgccgagcagacgaagcuguauggguccggcaacaagcuggugaccgucggcagcuccaacuaccagcagagcuucgugcccucccccggggcccggccccaggugaacggccucagcgggcggaucgacuuucacuggcugaugcugaaccccaacgacaccgucaccuucagcuucaacggcgcguuuaucgcccccgaccgcgccuccuuccuccggggcaagagcauggggauccaguccggcguccaaguggacgccaacugcgagggggacugcuaccauagcggcgggacgaucaucuccaaccugcccuuccagaacaucgacagccgcgccgugggcaagugcccgcgguacgugaagcagcgcucccugcuccuggcgaccgggaugaagaaugugcccgagauccccaagggccggggccuguucggggccaucgccggcuucaucgagaacgggugggagggccucaucgacgggugguacggcuuccgccaccagaacgcccagggcgaagggaccgccgcggacuauaagagcacccaguccgccaucgaccagaucacgggcaagcugaaccggcugaucgagaagaccaaccagcaguucgagcucaucgacaacgaguucaaugaggucgaaaagcagaucgggaacgugaucaacuggacccgcgacagcaucaccgaggugugguccuacaacgccgagcugcuggucgccauggagaaccagcacacgaucgaccucgccgauagcgagauggacaagcuguacgagcgcgugaagcggcagcugcgcgagaacgcggaagaggacggcaccggcugcuucgagaucuuccauaagugcgacgacgacugcauggccuccauccggaacaacaccuacgaccauagcaaguaccgcgaggaggccaugcagaaccggauccagaucgaccccgucaagcucuccagcggguacaaggacgugauccugugguucuccuuuggcgccagcugcuucauccugcucgcgaucgugauggggcuggucuucaucugcgugaagaacggcaacaugcgcugcaccaucugcaucuga

SEQ ID NO: 12619 - RNA, 1701 nt, Artificial Sequence
  derived and/or modified CDS sequence (AUadapt) from InfluenzaA__AIC64889__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccucguccuggagcuacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcuggugaagaaggagaacagcuaccccaagcucuccaagucguacaucaacgacaaggggaaggaggugcugguccuguggggcauccaccaccccagcaccuccgccgaccagcagucgcucuaccagaacgccgacgccuacguguucgugggguccagccgguacuccaagaaguucaagcccgagaucgccauccgcccgaagguccggggccaggagggccgcaugaacuacuacuggacgcugguggagcccggggacaagaucaccuucgaggcgaccggcaaccugguggucccccgguacgccuucgccauggagcgcaacgccgggucgggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgucgauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacucggucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcuggaguccacccgcaucuaccagauccucgcgaucuacagcaccgucgccucgucccuggugcugguggucagccucggggccaucuccuucuggaugugcagcaacggcucccugcagugccggaucugcaucuga

SEQ ID NO: 12620 - RNA, 1701 nt, Artificial Sequence; identical to SEQ ID NO: 10285
  derived and/or modified CDS sequence (AUadapt) from InfluenzaA__AIC73738__HA

SEQ ID NO: 12621 - RNA, 1701 nt, Artificial Sequence
  derived and/or modified CDS sequence (AUadapt) from InfluenzaA__AIC73739__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgccacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12622 - RNA, 1701 nt, Artificial Sequence
  derived and/or modified CDS sequence (AUadapt) from InfluenzaA__AIC73740__HA
augaaggccauccuggugguccuccuguacaccuucaccacggccaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccacccgcccacgaccgcggaccagcagucgcuguaccagaacgccgacgccuacguguucgugggcaccucccgguacagcaagaaguucaagcccgagaucgccauccgccccaagguccgggaccaggagggccgcaugaacuacuacuggacccugguggagcccggggacaagaucacguucgaggccaccggcaaccucguggucccccgguacgcguucaccauggagcgcaacgccggguccggcaucaucaucucggacaccccggugcacgacugcaacacgaccugccagacccccgagggcgccaucaacaccucccugcccuuccagaacauccaccccaucacgaucgggaagugcccgaaguacgucaagucgaccaagcugcggcucgccaccggccugcgcaacgugcccuccauccagagccgggggcuguucggcgccaucgcgggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcuggaccgggagaagaucgacggcgugcgccucgaguccacccggaucuaccagauccuggccaucuacucgaccgucgccuccagccuggugcucguggucucccugggggcgaucucguucuggaugugcagcaacggcucccugcagugccgcaucugcaucuga

SEQ ID NO: 12623 - RNA, 1701 nt, Artificial Sequence
  derived and/or modified CDS sequence (AUadapt) from InfluenzaA__AIC73741__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccacugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccaccgcugcgacaacgccugcaucggcuccauccggaacgggacguacgaccacaacguguaccgcgacgaggcccucaacaaccgguuccagauccgcggcguggagcucaagagcggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 12624 - RNA, 1701 nt, Artificial Sequence
  derived and/or modified CDS sequence (AUadapt) from InfluenzaA__AIC73742__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugcggcaguccuacaucaacgacaagggcaaggaggugcugguccucugggggauccaccaccccagcaccacgaccgaccagcagucgcuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagucgaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgccgugggcaaggaguucaaccaccuggagaagcggaucgagaaccugaaccgcaaggucgacgacggcuuccucgacaucuggacguacaacgcggagcugcuggugcuccuggagaacgagcggacccuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgccuccagccuggugcucguggucucccugggggcgaucucguucuggaugugcagcaacggcucccugcagugccggaucugcaucuga

SEQ ID NO: 12625 - RNA, 1701 nt, Artificial Sequence; identical to SEQ ID NO: 12624
  derived and/or modified CDS sequence (AUadapt) from InfluenzaA__AIC73743__HA

SEQ ID NO: 12626 - RNA, 1701 nt, Artificial Sequence
  derived and/or modified CDS sequence (AUadapt) from InfluenzaA__AIC73744__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugaaccaguccuacaucaacgacaagggcaaggaggugcugguccucugggggauccaccaccccucgaccacggccgaccagcagagccuguaccagaacgccgacgccuacguguucgugggcaccucccgguacucgaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacacccccgcccacgacugcaacaccacgugccagaccccggagggcgccaucaacaccucccugcccuuccagaacauccaccccaucaccaucgggaagugccccaaguacgucaagagcacgaagcugcggcucgcgaccggccugcgcaacgugccguccauccagucgcgggggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucacgaacaaggugaacuccgugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacagcaacgugaagaaccucuacgagaaggugcgcaaccagcugaagaacaacgccaaggagaucgggaacggcugcuucgaguucuaccacaagugcgacaacacgugcauggaguccgucaagaacgggaccuacgacuaccccaaguacucggaggaggccaagcugaaccgggagaagaucgacggcgugaagcucgaguccacccgcaucuaccagauccuggcgaucuacucgaccguggccuccagccugguccucguggugucccugggggccaucucguucuggaugugcagcaacggcucccugcagugccggaucugcaucuga

SEQ ID NO: 12627 - RNA, 1701 nt, Artificial Sequence
  derived and/or modified CDS sequence (AUadapt) from InfluenzaA__AIC73745__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacugggcgcugguggagcccggggacaagaucaccuucgaggccaccggcaaccucguggucccccgguacgccuucacgauggagcgcaacgccgggucgggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacaucccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 12628 - RNA, 1701 nt, Artificial Sequence
  derived and/or modified CDS sequence (AUadapt) from InfluenzaA__AIC73746__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucacgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgcggccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccaccgaccagcagucccuguaccagaacgcggacgccuacguguucgugggcaccucgcgguacuccaagaaguucaagcccgagaucgccauccgcccgaagguccgggaccaggagggccgcaugaacuacuacuggacgcugguggagcccggggacaagaucaccuucgaggccaccggcaaccucguggucccccgguacgccuucaccauggagcgcaacgcggggucgggcaucaucaucuccgacacgcccgugcacgacugcaacacgaccugccagaccccggagggcgccaucaacaccagccugcccuuccagaacauccaccccaucaccaucgggaagugccccaaguacgugaaguccaccaagcugcggcucgccaccggccugcgcaacgucccgucgauccagucccgggggcuguucggcgccaucgccggguucaucgagggcggcuggacggggaugguggacggcugguacggguaccaccaccagaacgagcagggcagcggguacgcggccgaccucaaguccacccagaacgccaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgcgaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggccaucucguucuggaugugcuccaacggcagccugcagugccggaucugcaucuga

SEQ ID NO: 12629 - RNA, 1701 nt, Artificial Sequence
  derived and/or modified CDS sequence (AUadapt) from InfluenzaA__AIC73747__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccucaucuggcuggugaagaaggggaacucguaccccaagcugucccagagcuacaucaacgacaagggcaaggaggugcucguccugugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacaccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcuccggcuggccaccggccugcgcaacgucccgagcauccagucccggggccucuucggggccaucgcgggguucaucgagggcggcuggaccgggaugguggacggcugguacggguaccaccaccagaacgagcagggcucgggguacgccgccgaccugaaguccacgcagaacgccaucgacaagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggagaagaucgacggcgugaagcuggagucgacccgcaucuaccagauccuggccaucuacuccaccgucgccucgucccucgugcugguggucagccugggggcgaucucguucuggaugugcuccaacggcagccuccagugccggaucugcaucuga

SEQ ID NO: 12630 - RNA, 1701 nt, Artificial Sequence; identical to SEQ ID NO: 10285
  derived and/or modified CDS sequence (AUadapt) from InfluenzaA__AIC73748__HA

SEQ ID NO: 12631 - RNA, 1701 nt, Artificial Sequence
  derived and/or modified CDS sequence (AUadapt) from InfluenzaA__AIC73749__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagcggugggaccuguucguggagcgcuccaaggccuacucgaacugcuaccccuacgacgugccggacuacgcgucccugcggagccucgucgccuccucgggcacccuggaguucaacgacgaguccuucaacugggccggggugacgcagaacggcaccagcuccgccugcauccgcgggucgaacuccagcuucuucucccggcugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccacuccagcggccgcaucaccgugucgaccaagcggucccagcaggccgugaucccgaacaucggcagccgcccccggauccgcaacauccccucccggaucucgaucuacuggaccaucgucaagcccggggacauccugcugaucaacuccacgggcaaccucaucgccccgcgcggguacuucaagauccagagcggcaaguccucgaucaugcgguccgacgcccccaucggcaagugcaagagcgagugcaucacccccaacggguccaucaccaacgacaagcccuuccagaacgugaaccgcaucaccuacggcgcgugcccgcgguacgugaagcagucgacgcugaagcuggccaccgggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacguggaggacaccaagaucgaccuguggucguacaacgccgagcugcucgucgcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcguggagcucaaguccggcuacaaggacuggauccuguggaucucguucgccaucagcugcuuccugcucugcgucgcccugcugggguucaucaugugggcgugccagaagggcaacauccggugcaacaucugcaucuga

SEQ ID NO: 12632 - RNA, 1701 nt, Artificial Sequence; identical to SEQ ID NO: 10285
  derived and/or modified CDS sequence (AUadapt) from InfluenzaA__AIC73750__HA

SEQ ID NO: 12633 - RNA, 1701 nt, Artificial Sequence
  derived and/or modified CDS sequence (AUadapt) from InfluenzaA__AIC73754__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacucccgcaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgucccuggugcucguggucagccugggggccaucucguucuggaugugcuccaacggcagccugcagugccgcaucugcaucuga

SEQ ID NO: 12634 - RNA, 1701 nt, Artificial Sequence; identical to SEQ ID NO: 10285
  derived and/or modified CDS sequence (AUadapt) from InfluenzaA__AIC73755__HA

SEQ ID NO: 12635 - RNA, 1701 nt, Artificial Sequence; identical to SEQ ID NO: 10285
  derived and/or modified CDS sequence (AUadapt) from InfluenzaA__AIC73756__HA

SEQ ID NO: 12636 - RNA, 1701 nt, Artificial Sequence; identical to SEQ ID NO: 10285
  derived and/or modified CDS sequence (AUadapt) from InfluenzaA__AIC73757__HA

SEQ ID NO: 12637 - RNA, 1701 nt, Artificial Sequence
  derived and/or modified CDS sequence (AUadapt) from InfluenzaA__AIC73758__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcaucgcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcugucccagucguacaucaacgacaagggcaaggaggugcuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12638 - RNA, 1701 nt, Artificial Sequence
  derived and/or modified CDS sequence (AUadapt) from InfluenzaA__AIC73760__HA
augaaggccauccugaucgugcuccuguacaccuucgccaccgcgaacgccgacacgcugugcaucggcuaccacgccaacaacucgaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcugucccagucguacaucaacgacaagggcaaggaggugcuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12639 - RNA, 1701 nt, Artificial Sequence; identical to SEQ ID NO: 12638
  derived and/or modified CDS sequence (AUadapt) from InfluenzaA__AIC73761__HA

SEQ ID NO: 12640 - RNA, 1701 nt, Artificial Sequence; identical to SEQ ID NO: 12165
  derived and/or modified CDS sequence (AUadapt) from InfluenzaA__AIC73762__HA

SEQ ID NO: 12641 - RNA, 1701 nt, Artificial Sequence
  derived and/or modified CDS sequence (AUadapt) from InfluenzaA__AIC73763__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagaucucccagucguacaucaacgacaagggcaaggaggugcugguccugugggggauccaccaccccagcaccacggccgaccagcagucccucuaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccugguggucccccgguacgccuucaccauggagcgcaacgccgggucgggcaucaucaucuccgacacccccgugcacgacugcaacaccacgugccagaccccggagggcgccaucaacaccagccuccccuuccagaacauccaccccaucaccaucgggaagugccccaaguacgugaaguccacgaagcugcggcuggccaccggccuccgcaacgucccgucgauccagucccgggggcuguucggcgcgaucgccggguucaucgagggcggcuggaccgggaugguggacggcugguacggguaccaccaccagaacgagcagggcagcggguacgccgccgaccugaaguccacccagaacgccaucgacaagaucacgaacaaggugaacucggucaucgagaagaugaacacccaguucaccgcggugggcaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcuggagagcacccgcaucuaccagauccucgccaucuacuccaccgucgcgucgucccuggugcugguggucagccucggggccaucucguucuggaugugcuccaacggcagccugcagugccggaucugcaucuga

SEQ ID NO: 12642 - RNA, 1701 nt, Artificial Sequence; identical to SEQ ID NO: 10285
  derived and/or modified CDS sequence (AUadapt) from InfluenzaA__AIC73765__HA

SEQ ID NO: 12643 - RNA, 1701 nt, Artificial Sequence; identical to SEQ ID NO: 10285
  derived and/or modified CDS sequence (AUadapt) from InfluenzaA__AIC73766__HA

SEQ ID NO: 12644 - RNA, 1701 nt, Artificial Sequence
  derived and/or modified CDS sequence (AUadapt) from InfluenzaA__AIC73767__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucaucaagaaggggaacucguaccccaagcugucccagagcuacaucaacgacaagggcaaggaggugcuggugcucugggggauccaccaccccucgaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggucaacagcgugaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgucaagaaccucuacgagaagauccgcaaccagcugaagaacaacgccaaggagaucgggaacggcugcuucgaguucuaccacaagugcgacaacaugugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12645 - RNA, 1701 nt, Artificial Sequence; identical to SEQ ID NO: 10285
  derived and/or modified CDS sequence (AUadapt) from InfluenzaA__AIC73768__HA

SEQ ID NO: 12646 - RNA, 1701 nt, Artificial Sequence; identical to SEQ ID NO: 10285
  derived and/or modified CDS sequence (AUadapt) from InfluenzaA__AIC73769__HA

SEQ ID NO: 12647 - RNA, 1701 nt, Artificial Sequence; identical to SEQ ID NO: 10285
  derived and/or modified CDS sequence (AUadapt) from InfluenzaA__AIC73770__HA

SEQ ID NO: 12648 - RNA, 1701 nt, Artificial Sequence; identical to SEQ ID NO: 10285
  derived and/or modified CDS sequence (AUadapt) from InfluenzaA__AIC73771__HA

SEQ ID NO: 12649 - RNA, 1701 nt, Artificial Sequence
  derived and/or modified CDS sequence (AUadapt) from InfluenzaA__AIC73772__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcgucuaccagauccuggccaucuacuccaccguggcgucgucccuggugcucgucgugagccugggggccaucucguucuggaugugcuccaacggcagccugcagugccggaucugcaucuga

SEQ ID NO: 12650 - RNA, 1701 nt, Artificial Sequence; identical to SEQ ID NO: 10285
  derived and/or modified CDS sequence (AUadapt) from InfluenzaA__AIC73773__HA

SEQ ID NO: 12651 - RNA, 1701 nt, Artificial Sequence; identical to SEQ ID NO: 10285
  derived and/or modified CDS sequence (AUadapt) from InfluenzaA__AIC73775__HA

SEQ ID NO: 12652 - RNA, 1701 nt, Artificial Sequence; identical to SEQ ID NO: 10285
  derived and/or modified CDS sequence (AUadapt) from InfluenzaA__AIC73776__HA

SEQ ID NO: 12653 - RNA, 1701 nt, Artificial Sequence; identical to SEQ ID NO: 12649
  derived and/or modified CDS sequence (AUadapt) from InfluenzaA__AIC73777__HA

SEQ ID NO: 12654 - RNA, 1701 nt, Artificial Sequence
  derived and/or modified CDS sequence (AUadapt) from InfluenzaA__AIC73778__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggcccacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12655 - RNA, 1701 nt, Artificial Sequence; identical to SEQ ID NO: 12654
  derived and/or modified CDS sequence (AUadapt) from InfluenzaA__AIC73779__HA

SEQ ID NO: 12656 - RNA, 1701 nt, Artificial Sequence; identical to SEQ ID NO: 12654
  derived and/or modified CDS sequence (AUadapt) from InfluenzaA__AIC73780__HA

SEQ ID NO: 12657 - RNA, 1701 nt, Artificial Sequence; identical to SEQ ID NO: 11243
  derived and/or modified CDS sequence (AUadapt) from InfluenzaA__AIC73781__HA

SEQ ID NO: 12658 - RNA, 1701 nt, Artificial Sequence; identical to SEQ ID NO: 12654
  derived and/or modified CDS sequence (AUadapt) from InfluenzaA__AIC73782__HA

SEQ ID NO: 12659 - RNA, 1701 nt, Artificial Sequence; identical to SEQ ID NO: 12654
  derived and/or modified CDS sequence (AUadapt) from InfluenzaA__AIC73783__HA

SEQ ID NO: 12660 - RNA, 1701 nt, Artificial Sequence; identical to SEQ ID NO: 12654
  derived and/or modified CDS sequence (AUadapt) from InfluenzaA__AIC73784__HA

SEQ ID NO: 12661 - RNA, 1701 nt, Artificial Sequence; identical to SEQ ID NO: 10285
  derived and/or modified CDS sequence (AUadapt) from InfluenzaA__AIC73785__HA

SEQ ID NO: 12662 - RNA, 1701 nt, Artificial Sequence; identical to SEQ ID NO: 12654
  derived and/or modified CDS sequence (AUadapt) from InfluenzaA__AIC73786__HA

SEQ ID NO: 12663 - RNA, 1701 nt, Artificial Sequence; identical to SEQ ID NO: 10285
  derived and/or modified CDS sequence (AUadapt) from InfluenzaA__AIC73787__HA

SEQ ID NO: 12664 - RNA, 1701 nt, Artificial Sequence; identical to SEQ ID NO: 10285
  derived and/or modified CDS sequence (AUadapt) from InfluenzaA__AIC73788__HA

SEQ ID NO: 12665 - RNA, 1701 nt, Artificial Sequence
  derived and/or modified CDS sequence (AUadapt) from InfluenzaA__AIC73789__HA
augaagaccaucaucgcccugucguacauccucugccugguguucgcccagaagcccccgggcaacgacaacuccaccgcgacgcugugccucgggcaccacgccguccccaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuacccguacgacgugcccgacuacgcgucccugcgcucgcuggucgccuccagcggcacccucgaguucaacaacgaguccuucaacugggccggggugacgcagaacggcaccucguccgccugcauccgggggagcaacuccucguucuucucccgccugaacuggcugacccaccucaacuucaaguaccccgcgcugaacgugaccaugcccaacaacgagcaguucgacaagcuguacaucuggggcguccaccacccggggacggacaaggaccagaucuuccucuacgcccagagcuccggccggaucaccgugagcaccaagcgcucgcagcaggccgugauccccaacaucggcucccggccccgcauccggaacauccccagccgcaucuccaucuacuggaccaucgucaagccgggggacauccugcugaucaacucgacgggcaaccucaucgcgccccggggguacuucaagauccgcuccggcaagagcuccaucaugcggucggacgcccccaucggcaagugcaaguccgagugcaucacccccaacgggagcaucccgaacgacaagcccuuccagaacgugaaccgcaucaccuacggcgccugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccucaaguccacccaggccgccaucgaccagaucaacggcaagcugaaccgccugaucggcaagaccaacgagaaguuccaccagaucgagaaggaguucagcgagguggaggggcggauccaggaccucgagaaguacgucgaggacacgaagaucgaccugugguccuacaacgccgagcugcucguggcccuggagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcucugcguggugcugcugggguucaucaugugggccugccagaagggcaacauccggugcaacaucugcaucuga

SEQ ID NO: 12666 - RNA, 1701 nt, Artificial Sequence
  derived and/or modified CDS sequence (AUadapt) from InfluenzaA__AIC73790__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacucguaccccaagcugcggcaguccuacaucaacgacaagggcaaggaggugcugguccucugggggauccaccaccccagcacgaccaccgaccagcagucgcuguaccagaacgcggacgccuacguguucgugggcaccucccgcuacagcaagaaguucaagcccgagaucgccauccggccgaagguccgcgaccaggagggccggaugaacuacuacuggacgcugguggagcccggggacaagaucaccuucgaggccaccggcaaccucguggucccccgcuacgccuucaccauggagcggaacgcgggguccggcaucaucaucucggacacgcccgugcacgacugcaacacgaccugccagaccccggagggcgccaucaacaccucccugcccuuccagaacauccaccccaucaccaucgggaagugccccaaguacgucaagucgaccaagcugcgccucgccaccggccugcggaacgugccguccauccagagccgcgggcuguucggcgccaucgccggguucaucgagggcggcuggacggggaugguggacggcugguacggguaccaccaccagaacgagcagggcuccggguacgcggccgaccucaagucgacccagaacgccaucgacaagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggaaccagcugaagaacaacgcgaaggagaucgggaacggcugcuucgaguucuaccacaagugcgacaacacgugcauggaguccgugaagaacgggaccuacgacuaccccaaguacucggaggaggccaagcugaaccgcgagaagaucgacggcgugaagcucgaguccacccggaucuaccagauccuggccaucuacucgaccgucgccuccagccuggugcucguggucucccugggggccaucucguucuggaugugcagcaacggcucccugcagugccgcaucugcaucuga

SEQ ID NO: 12667 - RNA, 1701 nt, Artificial Sequence
  derived and/or modified CDS sequence (AUadapt) from InfluenzaA__AIC73791__HA
augaaggccauccuggugguccuccuguacaccuucgccaccgcgaacgccgacacgcugugcaucggcuaccacgccaacaacucgaccgacaccaucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcugucccagucguacaucaacgacaagggcaaggaggugcuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12668 - RNA, 1701 nt, Artificial Sequence; identical to SEQ ID NO: 10285
  derived and/or modified CDS sequence (AUadapt) from InfluenzaA__AIC73792__HA

SEQ ID NO: 12669 - RNA, 1701 nt, Artificial Sequence; identical to SEQ ID NO: 12649
  derived and/or modified CDS sequence (AUadapt) from InfluenzaA__AIC73793__HA

SEQ ID NO: 12670 - RNA, 1701 nt, Artificial Sequence
  derived and/or modified CDS sequence (AUadapt) from InfluenzaA__AIC73794__HA
augaagaccaucaucggcgugucguacauccugugccucgucuucgcccagaagcugcccgggaacgacaacuccaccgccacgcugugccucggccaccacgcggugccgaacgggaccaucgugaagaccaucaccaacgaccgcaucgaggucacgaacgccaccgagcuggugcagaacagcuccaucggcgagaucugcgacucgccccaccagauccuggacggggagaacugcacccucaucgacgcccugcugggcgacccccagugcgacggcuuccagaacaagaagugggaccucuucguggagcgguccaaggccuacagcaacugcuaccccuacgacgucccggacuacgccucccugcgcucgcugguggcguccagcgggacccucgaguucaacaacgaguccuucaacugggccggcgugacgcagaacgggaccucguccagcugcauccggggcuccaacucguccuucuucagccgccugaacuggcugacccaccucaacuccaaguaccccgcccugaacgucaccaugcccaacaacgagcaguucgacaagcuguacaucuggggcgugcaccaccccgggacggacaaggaccagaucuuccucuacgcccagucgagcggccggaucaccguguccaccaagcgcucgcagcaggcggucaucccgaacaucgggucccggccccgcauccgggacauccccagccgcaucuccaucuacuggaccaucgugaagcccggcgacauccugcugaucaacucgacggggaaccucaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgucaagcaguccacccugaagcuggccacgggcaugcgcaacgugcccgagcggcagacccgcgggaucuucggcgcgaucgccggcuucaucgagaacgggugggagggcaugguggacgggugguacggcuuccggcaccagaacucggaggggcgcggccaggccgccgaccucaaguccacccaggccgcgaucgaccagaucaacggcaagcugaaccggcugaucgggaagaccaacgagaaguuccaccagaucgagaaggaguucagcgaggucgagggccgcauccaggaccucgagaaguacguggaggacacgaagaucgaccugugguccuacaacgccgagcugcucguggcccuggagaaccagcacaccaucgaccugaccgacucggagaugaacaagcuguucgagaagaccaagaagcagcuccgcgagaacgccgaggacauggggaacggcugcuucaagaucuaccacaagugcgacaacgccugcaucggguccauccggaacggcacguacgaccacgacgucuaccgcgacgaggcgcugaacaaccgguuccagaucaagggcguggagcucaagagcggguacaaggacuggauccuguggaucagcuucgccaucuccugcuuccugcucugcguggcccugcugggcuucaucaugugggccugccagaaggggaacauccgcugcaacaucugcaucuga

SEQ ID NO: 12671 - RNA, 1701 nt, Artificial Sequence; identical to SEQ ID NO: 10285
  derived and/or modified CDS sequence (AUadapt) from InfluenzaA__AIC73796__HA

SEQ ID NO: 12672 - RNA, 1701 nt, Artificial Sequence; identical to SEQ ID NO: 164
  derived and/or modified CDS sequence (AUadapt) from InfluenzaA__AIC73797__HA

SEQ ID NO: 12673 - RNA, 1701 nt, Artificial Sequence; identical to SEQ ID NO: 164
  derived and/or modified CDS sequence (AUadapt) from InfluenzaA__AIC73798__HA

SEQ ID NO: 12674 - RNA, 1701 nt, Artificial Sequence; identical to SEQ ID NO: 164
  derived and/or modified CDS sequence (AUadapt) from InfluenzaA__AIC73800__HA

SEQ ID NO: 12675 - RNA, 1701 nt, Artificial Sequence; identical to SEQ ID NO: 164
  derived and/or modified CDS sequence (AUadapt) from InfluenzaA__AIC73801__HA

SEQ ID NO: 12676 - RNA, 1701 nt, Artificial Sequence; identical to SEQ ID NO: 164
  derived and/or modified CDS sequence (AUadapt) from InfluenzaA__AIC73802__HA

SEQ ID NO: 12677 - RNA, 1701 nt, Artificial Sequence; identical to SEQ ID NO: 164
  derived and/or modified CDS sequence (AUadapt) from InfluenzaA__AIC73803__HA

SEQ ID NO: 12678 - RNA, 1701 nt, Artificial Sequence; identical to SEQ ID NO: 164
  derived and/or modified CDS sequence (AUadapt) from InfluenzaA__AIC73804__HA

SEQ ID NO: 12679 - RNA, 1701 nt, Artificial Sequence; identical to SEQ ID NO: 164
  derived and/or modified CDS sequence (AUadapt) from InfluenzaA__AIC73805__HA

SEQ ID NO: 12680 - RNA, 1701 nt, Artificial Sequence; identical to SEQ ID NO: 164
  derived and/or modified CDS sequence (AUadapt) from InfluenzaA__AIC73806__HA

SEQ ID NO: 12681 - RNA, 1701 nt, Artificial Sequence
  derived and/or modified CDS sequence (AUadapt) from InfluenzaA__AIC73807__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacaacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12682 - RNA, 1701 nt, Artificial Sequence; identical to SEQ ID NO: 164
  derived and/or modified CDS sequence (AUadapt) from InfluenzaA__AIC73808__HA

SEQ ID NO: 12683 - RNA, 1701 nt, Artificial Sequence
  derived and/or modified CDS sequence (AUadapt) from InfluenzaA__AIC73809__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugcggcaguccuacaucaacgacaagggcaaggaggugcugguccucugggggauccaccaccccagcaccacgaccgaccagcagucgcuguaccagaacgccgacgccuacguguucgugggcaccucccgcuacagcaagaaguucaagcccgagaucgccauccggccgaagguccgcgaccaggagggccggaugaacuacuacuggacccugguggagcccggggacaagaucacguucgaggccaccggcaaccucguggucccccgcuacgcguucaccauggagcggaacgccggguccggcaucaucaucucggacacccccgugcacgacugcaacacgaccugccagaccccggagggcgccaucaacaccucccugcccuuccagaacauccaccccaucacgaucgggaagugccccaaguacgucaagucgaccaagcugcgccucgccaccggccugcggaacgugccguccauccagagccgcgggcuguucggcgccaucgcgggguucaucgagggcggcuggaccgggaugguggacggcugguacggguaccaccaccagaacgagcagggcuccggguacgccgccgaccucaagucgacgcagaacgccaucgacaagaucaccaacaaggugaacuccgucaucgagaagaugaacacccaguucaccgccgugggcaaggaguucaaccaccuggagaagcggaucgagaaccugaacaagaaggucgacgacggcuuccucgacaucuggacguacaacgcggagcugcuggugcuccuggagaacgagcgcacccuggacuaccacgacagcaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgagaagaucgacgaggugaagcucgaguccacccggaucuaccagauccuggccaucuacucgaccgucgccuccagccuggugcucguggucucccugggcgcgaucucguucuggaugugcagcaacgggucccugcagugccgcaucugcaucuga

SEQ ID NO: 12684 - RNA, 1701 nt, Artificial Sequence
  derived and/or modified CDS sequence (AUadapt) from InfluenzaA__AIC73810__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccaccggugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgucccuggugcucguggucagccugggggccaucucguucuggaugugcuccaacggcagccugcagugccgcaucugcaucuga

SEQ ID NO: 12685 - RNA, 1701 nt, Artificial Sequence
  derived and/or modified CDS sequence (AUadapt) from InfluenzaA__AIC73813__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgcggccucgucccugguccucgugaucagccugggggccaucucguucuggaugugcuccaacggcagccugcagugccggaucugcaucuga

SEQ ID NO: 12686 - RNA, 1701 nt, Artificial Sequence; identical to SEQ ID NO: 68
  derived and/or modified CDS sequence (AUadapt) from InfluenzaA__AIC73815__HA

SEQ ID NO: 12687 - RNA, 1701 nt, Artificial Sequence; identical to SEQ ID NO: 12165
  derived and/or modified CDS sequence (AUadapt) from InfluenzaA__AIC73817__HA

SEQ ID NO: 12688 - RNA, 1701 nt, Artificial Sequence; identical to SEQ ID NO: 10285
  derived and/or modified CDS sequence (AUadapt) from InfluenzaA__AIC73819__HA

SEQ ID NO: 12689 - RNA, 1701 nt, Artificial Sequence
  derived and/or modified CDS sequence (AUadapt) from InfluenzaA__AIC73820__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacaucgaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 12690 - RNA, 1701 nt, Artificial Sequence; identical to SEQ ID NO: 10285
  derived and/or modified CDS sequence (AUadapt) from InfluenzaA__AIC73821__HA

SEQ ID NO: 12691 - RNA, 1701 nt, Artificial Sequence; identical to SEQ ID NO: 12649
  derived and/or modified CDS sequence (AUadapt) from InfluenzaA__AIC73824__HA

SEQ ID NO: 12692 - RNA, 1701 nt, Artificial Sequence; identical to SEQ ID NO: 10285
  derived and/or modified CDS sequence (AUadapt) from InfluenzaA__AIC73825__HA

SEQ ID NO: 12693 - RNA, 1701 nt, Artificial Sequence
  derived and/or modified CDS sequence (AUadapt) from InfluenzaA__AIC73827__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagccccugucgaccgcguccagcugguccuacaucguggagaccucguccucggacaacggcacgugcuaccccggcgacuucaucaacuacgaggagcuccgggagcagcuguccagcguguccucguucgagcgcuucgagaucuuccccaagaccuccagcuggccgaaccacgacuccaacaagggggucaccgccgccugcccccacgccggcgccaagucguucuacaagaaccugaucuggcucgugaagaaggggaacuccuaccccaagcugucgcaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagccggagaucgccauccgccccaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacaccccggugcacgacugcaacaccacgugccagacccccgagggcgccaucaacaccucccugcccuuccagaacauccaccccaucaccaucgggaagugcccgaaguacgucaagucgacgaagcugcggcucgccaccggccugcgcaacgugcccuccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccugauccucguggugucccugggggccaucucguucuggaugugcagcaacggcucccugcagugccggaucugcaucuga

SEQ ID NO: 12694 - RNA, 1701 nt, Artificial Sequence
  derived and/or modified CDS sequence (AUadapt) from InfluenzaA__AIC73828__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgcggccucgucccugguccucguggugagccugggggccaucucguucuggaugugcuccaacggcagccugcagugccggaucugcaucuga

SEQ ID NO: 12695 - RNA, 1701 nt, Artificial Sequence
  derived and/or modified CDS sequence (AUadapt) from InfluenzaA__AIC73830__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgcgagcagcugucguccgugucguccuucgagcgguucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgcuacuccaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgucccuggugcucguggucagccugggggccaucucguucuggaugugcuccaacggcagccugcagugccgcaucugcaucuga

SEQ ID NO: 12696 - RNA, 1701 nt, Artificial Sequence
  derived and/or modified CDS sequence (AUadapt) from InfluenzaA__AIC73833__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgcggccucgucccugguccucguggugagccugggggccaucucguucuggaugugcuccaacggcagccugcagugccggaucugcaucuga

SEQ ID NO: 12697 - RNA, 1701 nt, Artificial Sequence
  derived and/or modified CDS sequence (AUadapt) from InfluenzaA__AIC73834__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgacggcgccaaguccuucuacaagaaccugaucuggcucgugaagaaggggaacagcuaccccaagcugucccagucguacaucaacgacaagggcaaggaggugcugguccucugggggauccaccaccccagcaccacggcgggccagcagucccuguaccagaacgccgacgccuacguguucgugggcaccucgcgguacuccaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucaccauggagcgcaacgccggcucgggcaucaucaucuccgacacccccgugcacgacugcaacaccacgugccagaccccggagggggccaucaacaccagccugcccuuccagaacauccaccccaucaccaucggcaagugccccaaguacgugaaguccacgaagcugcggcucgccaccgggcugcgcaacgucccgucgauccagucccggggccuguucggggccaucgcgggcuucaucgagggcggguggaccggcaugguggacgggugguacggcuaccaccaccagaacgagcaggggagcggcuacgccgccgaccucaaguccacccagaacgccaucgacaagaucacgaacaaggugaacucggucaucgagaagaugaacacccaguucaccgccgugggcaaggaguucaaccaccuggagaagcgcaucgagaaccugaacaagaaggucgacgacggguuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagucggugaagaacggcaccuacgacuaccccaaguacuccgaggaggccaagcugaaccgggagaagaucgacggggugaagcucgagagcacccgcaucuaccagauccuggccaucuacuccaccgucgccucgucccuggugcucguggucagccugggcgcgaucucguucuggaugugcuccaacggcagccugcagugccggaucugcaucuga

SEQ ID NO: 12698 - RNA, 1701 nt, Artificial Sequence
  derived and/or modified CDS sequence (AUadapt) from InfluenzaA__AIC73835__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugaucgagcccggggacaagaucaccuucgaggcgacgggcaaccucguggugccccgguacgccuucaccauggagcgcaacgccgggagcggcaucaucaucuccgacacccccguccacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgugccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagucgacccgcaucuaccagauccuggccaucuacuccaccguggcgucgucccugguccucguggugagccugggggccaucucgcuguggaugugcuccaacggcagccuccagugccggaucugcaucuga

SEQ ID NO: 12699 - RNA, 1701 nt, Artificial Sequence; identical to SEQ ID NO: 12641
  derived and/or modified CDS sequence (AUadapt) from InfluenzaA__AIC73836__HA

SEQ ID NO: 12700 - RNA, 1701 nt, Artificial Sequence
  derived and/or modified CDS sequence (AUadapt) from InfluenzaA__AIC73837__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugaaggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagucgggcuacaaggacuggauccuguggaucuccuucgccaucagcugcuuccugcugugcgucgcccugcucggguucaucaugugggcgugccagaagggcaacauccggugcaacaucugcaucuga

SEQ ID NO: 12701 - RNA, 1701 nt, Artificial Sequence
  derived and/or modified CDS sequence (AUadapt) from InfluenzaA__AIC73838__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccucgggccggaucaccgugagcaccaagcgcucccagcaggccgugaucccgaacaucggcucgcggccccgcauccggaacauccccucccgcaucagcaucuacuggaccaucgucaagcccggggacauccugcugaucaacuccacgggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugauggacggcugguacggguuccgccaccagaacuccgagggccgggggcaggccgcggaccucaagucgacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggaccugggcaacgggugcuucaagaucuaccacaagugcgacaacgccugcaucggcucgauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggcgugccagaagggcaacauccggugcaacaucugcaucuga

SEQ ID NO: 12702 - RNA, 1701 nt, Artificial Sequence
  derived and/or modified CDS sequence (AUadapt) from InfluenzaA__AIC73839__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccgaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12703 - RNA, 1701 nt, Artificial Sequence; identical to SEQ ID NO: 10285
  derived and/or modified CDS sequence (AUadapt) from InfluenzaA__AIC73840__HA

SEQ ID NO: 12704 - RNA, 1701 nt, Artificial Sequence
  derived and/or modified CDS sequence (AUadapt) from InfluenzaA__AIC73841__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccaucgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccgggagcggcaucaucaucuccgacacccccgugcacgacugcaacacgaccugccagaccccggagggcgccaucaacaccucgcugcccuuccagaacauccaccccaucaccaucgggaagugccccaaguacgugaaguccaccaagcugcggcucgccacgggccugcgcaacaucccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacaagaucaccaacaaggugaacagcgugaucgagaagaugaacacgcaguucaccgcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12705 - RNA, 1701 nt, Artificial Sequence; identical to SEQ ID NO: 12700
  derived and/or modified CDS sequence (AUadapt) from InfluenzaA__AIC73842__HA

SEQ ID NO: 12706 - RNA, 1707 nt, Artificial Sequence
  derived and/or modified CDS sequence (AUadapt) from InfluenzaA__AID48082__HA
auggagaagaucgugcugcuguucgccaucgucucgcuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggucguacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccucgcugggcguguccagcgccugcccguaccagggcaaguccagcuucuuccgcaacguggucuggcugaucaagaagaacuccaccuaccccacgaucaagcggucguacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagucgaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacucgccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgggaguucaaccaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacgacgagugcauggagucggugcggaacggcaccuacgacuacccccaguacuccgaggaggcccgccucaagcgcgaggagaucagcggggucaagcuggaguccaucggcaucuaccagauccugagcaucuacuccacgguggccucgucccucgcccuggcgaucaugguggccgggcugagccucuggaugugcagcaacggcucccugcagugccggaucugcaucuga

SEQ ID NO: 12707 - RNA, 1701 nt, Artificial Sequence
  derived and/or modified CDS sequence (AUadapt) from InfluenzaA__AID70444__HA
augaaggccgugcuggucgugcuccuguacaccuucgccaccgcgaacgccgacacgcugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuggccaccgccuccagcugguccuacaucguggagaccucgaacuccgacaacggcacgugcuaccccggcgacuucaucgacuacgaggagcuccgggagcagcugagcuccgucucguccuucgagcgcuucgagaucuuccccaagaccagcuccuggcccaaccacgacucgaacaagggggugaccgccgccugcccgcacgcgggcgccaaguccuucuacaagaaccugaucuggcucgugaagaaggggaacagcuaccccaagcuguccaagucguacaucaacgacaagggccgggagguccuggugcucugggggauccaccaccccuccaccagcgccgaccagcagucgcuguaccagaacgccgacacguacguguucgucggcaccucccgcuacagcaagaaguucaagcccgagaucgccauccggccgaaggugcgcgaccaggagggccggaugaacuacuacuggacccugguggagcccggggacaagaucaccuucgaggcgacgggcaaccucgucgugccccgcuacgccuucgccauggagcggaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcgccucgcgacgggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggucaacuccgugaucgagaagaugaacacgcaguucaccgccgucggcaaggaguucaaccaccuggagaagcggaucgagaaccugaacaagaagguggacgacggcuuccucgacaucuggaccuacaacgccgagcugcuggugguccucgagaacgagcgcacccuggaguaccacgacucgaacgugaagaaccuguacgagaaggugcggucccaggucaagaacaacgccaaggagaucgggaacggcugcuucgaguucuaccacaagugcgacaacacgugcauggagagcgugaagaacgggaccuacgacuaccccaaguacuccgaggaggccaagcucaaccgcgaggagaucgacggcgugaagcuggagucgacccggaucuaccagauccuggcgaucuacuccaccgucgccagcucccucgugcugguggucucgcugggggccaucagcuucuggaugugcuucaacggcucccuccagugccgcaucuacaucuga

SEQ ID NO: 12708 - RNA, 1701 nt, Artificial Sequence
  derived and/or modified CDS sequence (AUadapt) from InfluenzaA__AID70445__HA
augaaggccauccuggugguccuccuguacaccuucgccaccgcgaacgccgacacccugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaucuacgacuaccccaaguacuccgaggaggccaagcugaaccgggaggagaucgacggcgucaagcuggagucgacccgcaucuaccagauccucgccaucuacuccaccguggcgagcucccuggugcaggucgugucgcugggggccaucagcuucuggaugugcuucaacggcucccuccagugccggaucugcaucuga

SEQ ID NO: 12709 - RNA, 1701 nt, Artificial Sequence
  derived and/or modified CDS sequence (AUadapt) from InfluenzaA__AID70446__HA
augaaggccgugcuggucgugcuccuguacaccuucgccaccgcgaacgccgacacccugugcaucggcuaccacgccaacaacucgaccgacaccguggacaccguccucgagaagaacgugacggugacccacuccgucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgucagcuccuucgagcgcuucgagaucuuccccaagaccucguccuggcccaaccacgacagcaacaagggggugaccgccgccugcccgcacgccggcgcgaaguccuucuacaagaaccugaucuggcucgugaagaaggggaacucguaccccaagcuguccaagagcuacaucaacgacaagggcaaggagauccugguccucugggggauccaccaccccucgaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccggcacccccgugcacgacugcaacaccacgugccagaccccgaagggggccaucaacaccagccugcccuuccagaacauccaccccaucaccaucggcaagugccccaaguacgugaaguccacgaagcugcggcucgccaccgggcugcgcaacgucccgucgauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggguuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucggcaacgggugcuucgaguucuaccacaagugcgacaacacgugcauggagagcgugaagaacggcaucuacgacuaccccaaguacuccgaggaggccaagcugaaccgggaggagaucgacggggucaagcuggagucgacccgcaucuaccagauccucgccaucuacuccaccguggcgagcucccuggugcaggucgugucgcugggcgccaucagcuucuggaugugcuucaacggcucccuccagugccggaucugcaucuga

SEQ ID NO: 12710 - RNA, 1701 nt, Artificial Sequence
  derived and/or modified CDS sequence (AUadapt) from InfluenzaA__AID70447__HA
augaaggccauccuggugguccuccuguacaccuucgccaccgcgaacgccgacacccugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcaggccggcgcgaagggguucuacaagaaccugcucuggcuggugaagaagggcaacuccuaccccaagcugagcaaguccuacaucaacgacaaggggaaggaggugcucguccuguggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccucguggagcccggcgacaagaucacguucgaggccaccgggaaccugguggucccccgguacgcguucgccauggagcgcaacgccggcuccggcaucaucaucagcgacacccccgugcacgacugcaacaccacgugccagaccccgaagggggccaucaacaccucccugcccuuccagaacauccaccccaucaccaucggcaagugccccaaguacgucaagucgacgaagcuccggcuggccaccgggcugcgcaacgugccguccauccagagccggggccucuucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccagcgugggcaaggaguucaaccaccuggagaagcgcauggagaaccugaacaagaaggucgacgacggguuccuggacaucuggaccuacaacgcggagcugcucguggugcuggagaacgagcggacgcuggaguaccacgacuccaacgucaagaaccucuacgagaaggugcgcaaccagcugaagaacaacgccaaggagaucggcaacgggugcuucgaguucuaccacaagugcgacaacacgugcauggagucggugaagaacggcaucuacgacuaccccaaguacuccgaggaggccaagcugaaccgggaggagaucgacggggucaagcucgagagcacccgcaucuaccagauccuggccaucuacuccaccguggccucgucccuggugcucgucgugagccugggcgcgaucagcuucuggaugugcuucaacggcucccugcagugccggaucugcaucuga

SEQ ID NO: 12711 - RNA, 1701 nt, Artificial Sequence
  derived and/or modified CDS sequence (AUadapt) from InfluenzaA__AID70448__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucaccauggagcgcgacgccggcuccggcaucaucaucagcgacacccccgugcacgacugcaacacgaccugccagaccccgaagggggccaucaacaccucccugcccuuccagaacauccaccccaucacgaucggcaagugccccaaguacgucaagucgaccaagcugcggcucgccaccgggcugcgcaacgugccguccauccagucgcggggccuguucggggccaucgcgggcuucaucgagggcggguggaccggcaugguggacgggugguacggcuaccaccaccagaacgagcagggguccggcuacgccgccgaccucaagagcacgcagaacgccaucgacaagaucaccaacaaggugaacuccgucaucgagaagaugaacacccaguucaccgccgugggcaaggaguucaaccaccuggagaagcgcaucgagaaccugaacaagaaggucgacgacggguuccucgacaucuggacguacaacgcggagcugcugguggugcucgagaacgagcggacccuggaguaccaggacucgaacgucaagaaccuguacgagaaggugcgcaaccagcucaagaacaacgccaaggagaucggcaacgggugccuggaguucuaccacaaguucgacaacacgugcauggaguccgugaagaacggcaccuacgacuaccccaaguacagcgaggaggccaagcugaaccgggagaagaucgacggggucaagcucgaguccacccgcaucuaccagauccuggccaucuacucgaccguggccuccagccuggugcucgucgugucccugggcaccaucucguucuggaugugcuucaacggcagccugcagugccggaucugcaucuga

SEQ ID NO: 12712 - RNA, 1701 nt, Artificial Sequence
  derived and/or modified CDS sequence (AUadapt) from InfluenzaA__AID70449__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagucgacccgcaucuaccagauccucgccaucuacuccaccguggcgagcucccuggugcuggucgugucgcucggggccaucagcuucuggaugugcuucaacggcucccugcagugccggaucugcguguga

SEQ ID NO: 12713 - RNA, 1701 nt, Artificial Sequence
  derived and/or modified CDS sequence (AUadapt) from InfluenzaA__AID70450__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucucggacacccccgugcacgacugcaacaccacgugccagaccuccaagggggccaucaacaccagccugccguuccagaacauccaccccaucaccaucggcaagugccccaaguacgugaaguccacgaagcugcggcucgccaccgggcugcgcaacguccccucgauccagucccggggccuguucggggcgaucgccggcuucaucgagggcggguggaccggcaugguggacgggugguacggcuaccaccaccagaacgagcaggggagcggcuacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggguuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucggcaacgggugcuucgaguucuaccacaaguucgacaacacgugcauggagagcgugaagaacggcaccuacgacuacccgaaguacuccgaggaggccaagcugaaccgggagaagaucgacggggucaagcuggagucgacccgcaucuaccagauccucgccaucuacuccaccguggcgagcucccuggugcaggucgugucgcugggcgccaucagcuucuggaugugcuucaacggcucccuccagugccggaucugcaucuga

SEQ ID NO: 12714 - RNA, 1701 nt, Artificial Sequence
  derived and/or modified CDS sequence (AUadapt) from InfluenzaA__AID70451__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccagcuccgacaacggcacgugcuaccccggcgacuucaucgacuacgaggagcugcgggagcagcucucguccgugagcuccuucgagcgcuucgagaucuuccccaagaccucguccuggcccaaccacgacagcaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagucgcggggccuguucggggcgaucgccggcuucaucgagggcggguggaccggcaugguggacgggugguacggcuaccaccaccagaacgagcagggguccggcuacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccugguggugcuggagaacgagcggacgcucgaguaccacgacucgaacgucaagaaccuguacgagaaggugcgcaaccagcugaagaacaacgccaaggagaucggcaacgggugcuucgaguucuaccacaaguucgacaacacgugcauggaguccgugaagaacggcaccuacgacuaccccaaguacagcgaggaggccaagcucaaccgggaggagaucgacggggucaagcuggaguccacccgcaucuaccagauccuggccaucuacucgaccguggcguccagccucgugcuggucgugucccugggcgccaucucguucuggaugugcuucaacggcagccuccagugccggaucugcaucuga

SEQ ID NO: 12715 - RNA, 1701 nt, Artificial Sequence
  derived and/or modified CDS sequence (AUadapt) from InfluenzaA__AID70452__HA
augaaggccauccuggugguccuccuguacaccuucgccaccgcgaacgccgacacccugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcuggggucgguguccagcuucaagcgcuucgagaucuuccccaagaccuccucguggcccaaccacgacuccaacaagggcgucaccgccgccugcccgcacgccggggcgaagggcuucuacaagaaccugaucuggcucgugaagaaggggaacucguaccccaagcuguccaagagcuacaucaacgacaagggcaaggaggugcugguccucuggggcauccaccaccccuccaccacggccgaccagcagucgcuguaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcgacgccggcucggggaucaucaucuccgacacccccgugcacgacugcaacaccacgugccagaccccgaagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggcuucaucgagggcggguggaccgggaugguggacggcugguacggguaccaccaccagaacgagcagggcucgggcuacgccgccgaccucaaguccacccagaacgccaucgacaagaucacgaacaaggugaacagcgucaucgagaagaugaacacccaguucaccgcgguggggaaggaguucaaccaccuggagaagcgcaucgagaaccugaacaagaaggucgacgacggcuuccucgacaucuggaccuacaacgccgagcugcugguggugcucgagaacgagcggacgcuggaguaccacgacuccaacgucaagaaccuguacgagaaggugcgcaaccagcucaagaacaacgccaaggagaucgggaacggcugcuucgaguucuaccacaagugcgacaacacgugcauggagucggugaagaacgggaucuacgacuaccccaaguacuccgaggaggccaagcugaaccgggagaagaucgacggcgucaagcuggagagcacccgcaucuaccagauccucgccaucuacuccaccguggcgucgucccuggugcuggucgugagccucggcgccaucuccuucuggaugcgguucaacgggucgcugcagugcagcaucugcaucuga

SEQ ID NO: 12716 - RNA, 1701 nt, Artificial Sequence
  derived and/or modified CDS sequence (AUadapt) from InfluenzaA__AID70453__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccucgaccacggccgaccagcagagccuguaccagaacgccgacaccuacguguucgugggcaccucccgguacucgaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucagcgacacccccgugcaggacugcaacaccacgugccagaccccgaagggggccaucaacaccucccugcccuuccagaacauccaccccaucaccaucggcaagugccccaaguacgucaagucgacgaagcugcggcucgugaccgggcugcgcaacgugccguccauccagucgcggggccuguucggggccaucgcgggcuucaucgagggcggguggaccggcaugguggacgggugguacggcuaccaccaccagaacgagcagggguccggcuacgccgccgaccucaagagcacccagaacgccaucgacaagaucacgaacaaggucaacuccgugaucgagaagaugaacacccaguucaccgccgucggcaaggaguucaaccaccuggagaagcgcaucgagaaccugaacaagaagguggacgacggguuccucgacaucuggaccuacaacgcggagcugcuggugguccucgagaacgagcggacgcuggaguaccacgacucgaaccugaagaaccucuacgagaaggugcgcaaccagcugaagaacaacgccaaggagaucggcaacgggugcuucgaguucuaccacaaguucgacaacacgugcauggaguccgugaagaacggcaccuacgacuaccccaaguacagcgaggaggccaagcugaaccgggaggagaucgacggggucaagcucgaguccacccgcaucuaccagauccuggccaucuacucgaccguggccuccagccuggugcaggucgugucccucggcgcgaucucguucuggaugcgguucaacggcagccugcacugccgcaucugcaucuga

SEQ ID NO: 12717 - RNA, 1701 nt, Artificial Sequence
  derived and/or modified CDS sequence (AUadapt) from InfluenzaA__AID70454__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggagcggcaucaucaucuccgacacccccgugcacgacugcaacacgaccugccagaccccgaagggcgccaucaacaccucgcugcccuuccagaacauccaccccaucaccaucgggaagugccccaaguacgugaaguccaccaagaugcggcuggcgacgggccuccgcaacgucccgugcauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucaccaacaaggugaacuccgucaucgagaagaugaacacgcaguucaccgccgugggcaaggaguucaaccaccuggagaagcgcaucgagaaccugaacaagaaggucgacgacggcuuccuggacaucuggaccuacaacgccgagcuccugguggugcuggagaacgagcggacccucgacuaccacgacucgaacgucaagaaccuguacgagaaggugcgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacucgaccguggccuccagccucgugcuggucgugucccugggggccaucucguucuggaugugcagcaacggcucccuccagugccggaucugcaucuga

SEQ ID NO: 12718 - RNA, 1701 nt, Artificial Sequence
  derived and/or modified CDS sequence (AUadapt) from InfluenzaA__AID70455__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugggcggggucgcgccccugcaccucggcaagugcaacaucgccggguggauccugggcaacccggagugcgagucgcuguccaccgccagcuccuggucguacaucguggagaccuccagcuccgacaacggcacgugcuaccccggggacuucaucgacuacgaggagcuccgcgagcagcugucguccgugagcuccuucgagcgguucgagaucuuccccaagaccucguccuggcccaaccacgacagcaacaagggcgucaccgccgccugcccgcacgccggggcgaagggcuucuacaagaaccugaucuggcucgugaagaaggggaacuccuaccccaagaucucgaaguccuacaucaacgacaagggcaaggaggugcugguccuguggggcauccaccaccccagcaccacggccgaccagcagucgcucuaccagaacgccgacaccuacaucuucguggggaccucccgcuacagcaagaaguucaagcccgagaucgccauccggccgaaggugcgcgaccaggagggccggaugaacuacuacuggacccuggucgagcccggggacaagaucacguucgaggccaccggcaaccugguggugccccgcuacgcguucgccauggagcgggacgccggcuccgggaucaucaucucggacacccccguccacgacugcaacaccacgugccagaccccgaagggcgccaucaacaccucccuccccuuccagaacauccaccccaucaccaucgggaagugccccaaguacgucaagagcacgaagcugcgccuggccaccggccuccggaacgugccguccauccagucgcgcgggcuguucggcgcgaucgccggcuucaucgagggcggguggaccgggaugguggacggcugguacggguaccaccaccagaacgagcagggcuccggcuacgccgccgaccucaagagcacccagaacgccaucgacaagaucacgaacaaggugaacuccgugaucaagaagaugaacacccaguucaccgcggucgggaaggaguucaaccaccuggagaagcggaucgagaaccugaacaagaagguggacgacggcuuccuggacaucuggaccuacaacgccgagcuccuggucgugcuggagaacgagcgcacgcucgaguaccacgacucgaacgugaagaaccuguacgagaagguccggaaccagcugaagaacaacgccaaggagaucgggaacggcugcuucgaguucuaccacaaguucgacaacacgugcauggaguccgugaagaacgggaccuacgacuaccccaaguacagcgaggaggccaagcucaaccgcgaggagaucgacggcgugaagcuggaguccacccggaucuaccagauccuggccaucuacucgaccgucgcguccagccucgugcugguggucucccugggcgccaucucguucuggaugugcuucaacgggagccuccagugccgcaucugcaucuga

SEQ ID NO: 12719 - RNA, 1701 nt, Artificial Sequence
  derived and/or modified CDS sequence (AUadapt) from InfluenzaA__AID70456__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcgguggucaaggaguucaaccaccuggagaagcgcaucgagaaccugaacaagaagguggacgacggcuuccucgacaucuggaccuacaacgccgagcugcuggugguccucgagaacgagcggacgcuggaguaccacgacuccaaccugaagaaccucuacgagaaggugcgcaaccagcugaagaacaacgccaaggagaucggcaacgggugcuucgaguucuaccacaaguucgacaacacgugcauggagucggugaagaacggcaccuacgacuaccccaaguacuccgaggaggccaagcugaaccgggaggagaucgacggggucaagcucgagagcacccgcaucuaccagauccuggccaucuacuccaccguggcgucgucccuggugcaggucgugagccucggcgccaucagcuucuggaugugcuucaacgggucccugcagugccggaucugcaucuga

SEQ ID NO: 12720 - RNA, 1701 nt, Artificial Sequence
  derived and/or modified CDS sequence (AUadapt) from InfluenzaA__AID70457__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcgacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcugguggugcucgagaacgagcggacgcuggaguaccacgacagcaacgucaagaaccuguacgagaaggugcgcaaccagcucaagaacaacgccaaggagaucggcaacgggugcuucgaguucuaccacaaguucgacaacacgugcauggaguccgugaagaacggcaccuacgacuaccccaaguacucggaggaggccaagcugaaccgggagaagaucgacggggucaagcuggaguccacccgcaucuaccagauccucgccaucuacucgaccguggcguccagccuggugcaggucgugucccugggcgccaucucguucuggaagugcuucaacggcagccuccagugccggaucugcuccuga

SEQ ID NO: 12721 - RNA, 1701 nt, Artificial Sequence
  derived and/or modified CDS sequence (AUadapt) from InfluenzaA__AID70458__HA
augaagaccaucaucgcccugucguacauccucugccugguguucgcccagaaguuccccggcaacgacaacuccauggcgacccugugccucgggcaccacgccgucccgaacggcacgauggugaagaccaucaccaacgaccagaucgaggugaccaacgccacggagcugguccagagcuccucgaccgggggcaucugcaacagcccccaccagauccuggacgggggcaacugcacccucaucgacgcccugcugggcgacccccagugcgacggguuccagaacaagaagugggaccucuucguggagcgcuccaaggccuacuccaacugcuaccccuacgacgugccggacuacgcgagccugcgguccaucgucgccucguccggcacccuggaguucaacaacgagagcuucaacuggacgggggugacccagaacggcaaguccgccucgugcaagcgcggguccgacaacagcuucuucucccggcucaacuggcugacccaccugaacuacaaguaccccgcccucaaggugaccaugcccaacaacgagaaguucgacaagcuguacaucuggggcguccaccaccccggcacguacaacgaccagaucagccuguacgcgcaggccuccgggaucaucaccgugucgaccaagcgcaaccagcagaccgugaucccgaacaucggcagccggccccgcguccgggacauccccucccgcaucagcaucuacuggacgaucgugaagcccggggacauccuccugaucaacuccaccggcaaccugaucgccccgcggggcuacuucaagauccagucggggaaguccagcaucaugcgcuccgacgcccccaucggcaagugcaacucggagugcaucacccccaacggguccauccccaacgacaagccguuccagaacgugaaccggaucaccuacggcgccugcccccgcuacgucaagcagaacacgcucaagcuggcgaccgggaugcggaacgugcccgagaagcagacccgcggcaucuucggcgccaucgccggguucaucgagaacggcugggaggggaugguggacggcugguacggguuccggcaccagaacagcgagggcaugggccaggccgccgaccugaaguccacccaggcggccaucaaccagaucaacgggaagcucaaccgccugaucggcaagacgaucgagaaguuccaccagaucgagaaggaguucagcgaggucgaggggcggauccaggaccuggagaaguacguggaggacaccaagaucgaccucugguccuacaacgccgagcugcugguggcccucgagaaccagcacaccaucgaccugaccgacucggagauggacaagcuguucgagcgcacgaagaagcagaugcgggagaacgccgaggacaugggcaacgggugcuucaagaucuaccacaagugcgacaacgcgugcaucggcuccauccgcaacggcaucuacgaccgggacaucuaccgcgacgaggcccucagcaaccgcuuccagaucaagggggucgagcugaaggccggcuacaaggacuggauccuguggaucuccuucgccaucagcugcuuccuccugugcguggugcugcucggguucaucaugugggccugccagaagggcaaccugcggugcaacaucugcaucuga

SEQ ID NO: 12722 - RNA, 1701 nt, Artificial Sequence
  derived and/or modified CDS sequence (AUadapt) from InfluenzaA__AID70459__HA
augaagaccaucaucgcccugucguacauccucugccugguguucgcccagaagguccccggcaacgacaacuccaccgcgacgcugugccucgggcaccacgccgugccgaacggcaccaucgugaagaccaucaccaacgaccagaucgaggucacgaacgccaccgagcuggugcagagcuccucgaccggggagaucugcaacagcccccaccagauccuggacggcgagaacugcacccucaucgacgcccugcugggggacccccagugcgacggcuuccagaacaagaagugggaccucuucguggagcgcucgaaggcccacuccaacugcuaccccuacgacgucccggacuacgcgagccugcggucccugguggccucguccggcacgcucgaguucaacaacgagagcuucaacuggaccggggugacccagaacggcaccuccucggccugcauccgccgguccaacaacagcuucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccucggggcggaucaccguguccacgaagaagucccagcaggccgucaucccgaacaucggcagccgcccccgggugcgcaacauccccucccgggugucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaacagcgcgugcaucacccccaacggcuccauccccaacgacaagccguuccagaacgugaaccggaucacguacggggccugcccccgcuacgugaagcagaacacccugaagcuggcccccggcaugcggaacguccccgagaagcagacccgcgggaucuucggcgccaucgccggguucaucgagaacggcugggagggcaugguggacgggugguacggcuuccggcaccagaacucggaggggcgcggccaggcggccgaccucaaguccacccaggccgccaucgaccagaucaacgggaagcugaaccggcugaucggcaagacgaucgagaaguuccaccagaucgagaacgaguucagcgagguggagggccgcauccaggaccucgagaaguacgucgaggacaccaagaucgaccugugguccuacaucgccgagcugcucguggcgcuggagaaccagcacaccaucgaccugaccgacucggagaugaacaagcuguucgagaagacgaagaagcagcuccgggagaacgccgaggacauggggaacggcugcuucaagaucuaccacaagugcgacaacgccugcaucggguccauccgcaacggcaucuacgaccacgacguguaccgcgacgaggcccugaacaaccgguuccagaucaagggggucgagcucaagagcggcuacaaggacuggauccuguggaucuccuucgccaucagcugcuuccugcucugcguggcgcugcugggcuucaucaugugggccugccagaaggggaacauccgcugcaacaucugcaucuga

SEQ ID NO: 12723 - RNA, 1701 nt, Artificial Sequence
  derived and/or modified CDS sequence (AUadapt) from InfluenzaA__AID70460__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucucggagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaucuacgaccacgacguguaccgcgacgaggcccucaacaaccgguuccagaucaaggggguggagcucaagucgggcuacaaggacuggauccuguggaucuccuucgccaucagcugcuuccugcugugcgucgcgcugcucggcuucaucaugugggccugccagaaggggaacauccgcugcaacaucugcaucuga

SEQ ID NO: 12724 - RNA, 1701 nt, Artificial Sequence
  derived and/or modified CDS sequence (AUadapt) from InfluenzaA__AID70461__HA
augaagaccaucaucgcccugucguacauccucugccugguguucgcccagaagcugcccggcaacgacaacuccaccgcgacccucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggagugcaucacccccaacggcuccauccccaacgacaagccguuccagaacgucaaccggaucacguacggggcgugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggccgcggaccugaaguccacgcaggccgccaucgaccagaucaacgggaagcugaaccggcucaucggcaagaccaucgagaaguuccaccagaucgagaaggaguucucggagguggagggccgcauccaggaccuggagaaguacaucgaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaucuacgaccacgacgucuaccgcgacgaggcccucaacaaccgguuccagaucaaggggguggagcucaagucgggcuacaaggacuggauccuguggaucuccuucgccaucagcugcuuccugcugugcguggcccugcucggcuucaucaugugggcgugccagaaggggaacauccgcugcaucacgugcaucuga

SEQ ID NO: 12725 - RNA, 1701 nt, Artificial Sequence
  derived and/or modified CDS sequence (AUadapt) from InfluenzaA__AID70463__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcagcaaggcccacuccaacugcuaccccuacgacgugccggacuacgcgucgcugcggucccuggucgccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcuggccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccucaaguccacgcaggccgccaucgaccagaucaacgggaagcugaaccggcugaucggcaagaccaucgagaaguuccaccagaucgagaaggaguucucggagguggagggccgcauccaggaccucgagaaguacguggaggacaccaagaucgaccugugguccuacaacgccgagcugcucgucgcgcuggagaaccagcacaccaucgaccugacggacagcgagaugaacaagcuguucgagaagaccaagaagcagcuccgggagaacgccgaggacauggggaacggcugcuucaagaucuaccacaagugcgacaacgccugcaucggguccauccgcaacggcaucuacgaccacgacguguaccgcgacgaggcccugaacaaccgguuccagaucaaggggguggagcucaagucgggcuacaaggacuggauccuguggaucuccuucgccaucagcugcuuccugcucugcgucgcgcugcugggcuucaucaugugggccugccagaaggggaacauccgcugcaacaucugcaucuga

SEQ ID NO: 12726 - RNA, 1701 nt, Artificial Sequence
  derived and/or modified CDS sequence (AUadapt) from InfluenzaA__AID70464__HA
augaagaccaucaucgcccugucguacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagaagucccagcaggccgugaucccgaacaucggcagccgcccccggguccgcaacauccccucccgggugucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucucggagguggagggccgcauccaggaccuggagaaguacguggaggacaccaagaucgaccugugguccuacaacgccgagcuccuggucgcgcuggagaaccagcacaccaucgaccucacggacagcgagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcucaagucgggcuacaaggacuggauccuguggaucuccuucgccaucagcugcuuccugcugugcgucgcgcugcucggcuucaucaugugggccugccagaaggggaacauccgcugcaacaucugcaucuga

SEQ ID NO: 12727 - RNA, 1701 nt, Artificial Sequence
  derived and/or modified CDS sequence (AUadapt) from InfluenzaA__AID70465__HA
augaagaccaucaucgcccugucguacauccucugccugguguucgcccagaagcugcccggcgacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucucggagguggagggccgcauccaggaccuggagaaguacguggaggacaccaagaucgaccugugguccuacaacgccgagcuccuggucgcgcuggagaaccaccacgccaucgaccucaccgacagcgagaugaacaagcuguucgagaagacgaagaagcagaugcgggagaacgccgaggacauggggaacggcugcuucaagaucuaccugaagugcgacaacgccugcaucggguccauccgcaacggcaucuacgaccacgacguguaccgcgacgaggcccucaacaaccgguuccagaucaaggggguggagcucaagucgggcuacaaggacuggauccuguggaucuccuucaccgagagcugcuuccugcugugcgucgcgcugcucggcuucaucaugugggccugccagaaggggaacauccgcugcaacaucugcaucuga

SEQ ID NO: 12728 - RNA, 1701 nt, Artificial Sequence
  derived and/or modified CDS sequence (AUadapt) from InfluenzaA__AID70466__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagaagucccagcaggccgugaucccgaacaucggcagccgcccccggguccgcaacauccccucccgggugucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaucgagaaguuccaccagaucgagaacgaguucagcgagguggagggccgcauccaggaccuggagaaguacguggaggacaccaagaucgaccugugguccuacaucggggagcuccuggucgcccuggagaaccagcacaccaucgaccucacggacucggagaugaacaagcuguucgagaagaccaagaagcagcugcgggagaacgcggaggacaugggcaacgggugcuucaagaucuaccacaagugcgacaacgccugcaucggcuccauccgcaacgggaucuacgaccacgacguguaccgcgacgaggcccucaacaaccgguuccagaucaagggcguggagcucaagagcggcuacaaggacuggauccuguggaucuccuucgccaucagcugcuuccugcugugcgucgcccugcucggguucaucaugugggcgugccagaagggcaacauccgcugcaacaucugcaucuga

SEQ ID NO: 12729 - RNA, 1701 nt, Artificial Sequence
  derived and/or modified CDS sequence (AUadapt) from InfluenzaA__AID70467__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacugcgaggggcgcggccaggcggccgaccucaagagcacgcaggccgccaucgaccagaucaacgggaagcugaaccggcucaucggcaagaccaucgagaaguuccaccagaucgagaacgaguucuccgagguggagggccgcauccaggggcuggagaaguacguggaggacaccaagaucgaccuguggucguacaucgccgagcucaucgucgcgcuggagaaccagcacaccaucgaccugacggacuccgagaugaacaagcuguucgagaagaccaagaagcagaugcgggagaacgccgaggacaugggcaacgggugcuucaagaucuaccacaagugcgacaacgccugcaucggcagcauccgcaacgggaucuacgaccacgacguguaccgcgacgaggcccugaacaaccgguuccagaucaagggcguggagcugaaguccggcuacaaggacuggauccucuggaucagcuucgccaucuccugcuuccugcugugcgucgcgcuccugggguucaucaugugggccugccagaagggcaacauccgcugcaacaucugcaucuga

SEQ ID NO: 12730 - RNA, 1701 nt, Artificial Sequence
  derived and/or modified CDS sequence (AUadapt) from InfluenzaA__AID70468__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcuccaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcgugucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacugcgaggggcggggccaggcggccgaccucaagucgacgcaggccgccaucgaccagaucaacgggaagcugaaccgccucaugggcaaguccaucgagaaguuccaccagaucgagaacgaguucagcgagguggagggccggauccaggggcuggagaaguacguggaggacaccaagaucgaccugugguccuacaacggcgagcucaucgucgcccuggagaaccagcacgcgaucgaccugaccgacucggagaugaacaagcuguucgagaagaccaagaagcagaugcgcgagaacgccgaggacauggggaacggcugcuucaagaucuaccugaagugcgacaacgccugcaucggguccauccgcaacggcaucuacgaccacgacguguaccgggacgaggcccugaacaaccgcuuccagaucaagggcguggagcucaagagcggguacaaggacuggauccuguggaucuccuucacgaucagcugcuuccugcucugcgucgcccugcugggcuucaucaugugggcgcggcagaaggggaacauccgcugcaacaucugcaucuga

SEQ ID NO: 12731 - RNA, 1701 nt, Artificial Sequence
  derived and/or modified CDS sequence (AUadapt) from InfluenzaA__AID70469__HA
augaagaccaucaucgcccugucguacauccucugccugguguucgcccagaagguccccggcaacgagaacuccaccgcgacgcugugccucgggcaccacgccgugccgaacggcaccaucgugaagaccaucaccaacgaccagaucgaggucacgaacgccaccgagcuggugcagagcuccucgaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgucccggacuacgcgucgcugcggucccugguggccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccagcgggcggaucaccguguccacgaagcgcucgcagcaggccgucaucccgaacaucggcagccggccccgcgugcggaacauccccucccgcgugucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacugcgaggggcggggccaggcggccgaccucaagucgacgcaggccgccaucgaccagaucaacgggaagcugaaccgccugaucggcaagaccaucgagaaguuccaccagaucgagaaggaguucuccgagguggagggccggauccaggggcucgagaaguacgucgaggacaccaagaucgaccuguggagcuacaacgccgagcugcucguggcgcuggagaaccagcacaccaucgaccugacggacuccgagaugaacaagcuguucgagaagaccaagaagcagaugcgcgagaacgccgaggacaugggcaacgggugcuucaagaucuaccacaagugcgacaacgccugcaucggcucgauccgcaacgggaucuacgaccacgacguguaccgggacgaggcccucaacaaccgcuuccagaucaagggcgucgagcugaaguccggcuacaaggacuggauccucuggaucagcuucaccaucuccugcuuccugcugugcguggcccuccugggguucaucaugugggcgugccagaagggcaacauccggugcaacaucugcaucuga

SEQ ID NO: 12732 - RNA, 1701 nt, Artificial Sequence
  derived and/or modified CDS sequence (AUadapt) from InfluenzaA__AID70470__HA
augaagaccaucaucgcccugucguacauccucugccugguguucgcccagaagguccccggcaacgagaacuccaccgcgacgcugugccucgggcaccacgccgugccgaacggcaccaucgugaagaccaucaccaacgaccagaucgaggucacgaacgccaccgagcuggugcagagcuccucgaccggggagaucugcaacagcccccaccagauccuggacggcgagaacugcacccucaucgacgcccugcugggggacccccagugcgacggcuuccagaacaagaagugggaccucuucguggagcgcuccaaggcccacuccaacugcuaccccuacgacgucccggacuacgcgucgcugcggucccugguggccagcuccggcacgcucgaguucaacaacgagucguucaacuggaccggggugacccagaacggcaccuccagcgccugcauccgccgguccaacaacucguucuucucccgccugaacuggcugacgcaccucaacuucaaguaccccgcccugaacgucaccaugcccaacaacgagcaguucgacaagcuguacaucuggggcgugcaccaccccgggaccgacaaggaccagaucuuccucuacgcgcaggccagcgggcggaucaccguguccacgaagcgcucgcagcaggccgucaucccgaacaucggcagccggccccgcgugcggaacauccccucccgcgugucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaacagcgcgugcaucacccccaacggcuccauccccaacgacaagccguuccagaacgugaaccgcaucacguacggggccugcccccgguacgugaagcagaacacccugaagcuggccaccggcaugcgcaacguccccgagaagcagacccgggggaucuucggcgccaucgccggguucaucgagaacggcugggagggcaugguggacgggugguacggcuuccgccaccagaacugcgaggggcggggccaggcggccgaccucaagucgacgcaggccgccaucgaccagaucaacgggaagcugaaccgccugaucggcaagaccaucgagaaguuccaccagaucgagaaggaguucuccgagguggagggccggauccaggggcucgagaaguacgucgaggacaccaagaucgaccuguggagcuacaacggcgagcugcucguggcccuggagaaccaccacaccaucgaccugacggacuccgagaugaacaagcuguucgagaagaccaagaagcagaugcgcgagaacgcggaggacauggggaacggcugcuucaagaucuaccacaagugcgacaacgccugcaucgggucgauccgcaacggcaucuacgaccacgacguguaccgggacgaggcccucaacaaccgcuuccagaucaagggcgucgagcugaaguccggguacaaggacuggauccucuggaucagcuucaccaucuccugcuuccugcugugcguggcccuccugggcuucaucaugugggccugccagaaggggaacauccggugcaacaucugcaucuga

SEQ ID NO: 12733 - RNA, 1701 nt, Artificial Sequence
  derived and/or modified CDS sequence (AUadapt) from InfluenzaA__AID70471__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcaacucgccccaccagauccucgacggcgagaacugcacgcugaucgacgcccugcucggggacccccagugcgacggcuuccagaacaagaagugggaccuguucguggagcgcagcaaggcccacuccaacugcuaccccuacgacgugccggacuacgccucgcugcggucccucgucgcgagcuccggcacccuggaguucaacaacgagucguucaacuggaccggggugacccagaacggcacguccagcgccugcauccgccgguccaacaacucguucuucucccgccugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcgagcgggcggaucacgguguccaccaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggccugcaucacgcccaacggcuccauccccaacgacaagccguuccagaacgucaaccggaucaccuacggggcgugcccccgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacagcgaggggcgcggccaggccgcggaccugaaguccacccaggccgccaucgaccagaucaacgggaagcugaaccggcucaucggcaagaccaucgagaaguuccaccagaucgagaacgaguucucggagguggagggccgcauccaggaccuggagaaguacguggaggacaccaagaucgaccugugguccuacaacgccgagcucaucgucgcccuggagaaccaccacacgaucgaccugaccgacagcgagaugaacaagcuguucgagaagaccaagaagcagaugcgggagaacgcggaggacauggggaacggcugcuucaagaucuaccacaagugcgacaacgccugcaucggguccauccgcaacggcaucuacgaccacgacguguaccgcgacgaggcccugaacaaccgguuccagaucaaggggguggagcucaagucgggcuacaaggacuggauccucuggaucuccuucgccaucagcugcuuccugaucugcgucgcccugcucggcuucaucaugugggcgugccagaaggggaaccugcgcugcaacaucugcaucuga

SEQ ID NO: 12734 - RNA, 1701 nt, Artificial Sequence
  derived and/or modified CDS sequence (AUadapt) from InfluenzaA__AID70472__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacgcaggccgccaucgaccagaucaacgggaagcugaaccggcucaucggcaagaccaucgagaaguuccaccagaucgagaaggaguucucggagguggagggccgcauccaggaccuggagaaguacguggaggacaccaagaucgaccugugguccuacaacgccgagcuccuggucgcgcuggagaaccaccacaccaucgaccucacggacagcgagaugaacaagcuguucgagaagaccaagaagcagaugcgggagaacgccgaggacauggggaacggcugcuucaagaucuaccacaagugcgacaacgccugcaucggguccauccgcaacggcaucuacgaccacgacguguaccgcgacgaggcccugaacaaccgguuccagaucaaggggguggagcucaagucgggcuacaaggacuggauccuguggaucuccuucgccaucagcugcuuccugcucugcgucgcgcugcugggcuucaucaugugggccugccagaaggggaacauccgcugcaacaucugcaucuga

SEQ ID NO: 12735 - RNA, 1701 nt, Artificial Sequence
  derived and/or modified CDS sequence (AUadapt) from InfluenzaA__AID70473__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagaagucccagcaggccgugaucccgaacaucggcagccgcccccggguccgcaacauccccucccgggugucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacugcgaggggcgcggccaggcggccgaccucaagucgacgcaggccgccaucgaccagaucaacgggaagcugaaccggcugaucggcaagaccaucgagaaguuccaccagaucgagaaggaguucuccgagguggagggccgcauccaggggcuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagaugcgggagaacgccgaggacaugggcaacgggugcuucaagaucuaccacaagugcgacaacgccugcaucggcucgauccgcaacgggaucuacgaccacgacguguaccgcgacgaggcccugaacaaccgguuccagaucaagggcguggagcucaaguccggcuacaaggacuggauccuguggaucagcuucgccaucuccugcuuccugcucugcgucgcgcugcugggguucaucaugugggccugccagaagggcaacauccgcugcaacaucugcaucuga

SEQ ID NO: 12736 - RNA, 1701 nt, Artificial Sequence
  derived and/or modified CDS sequence (AUadapt) from InfluenzaA__AID70474__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagaagucccagcaggccgugaucccgaacaucggcagccgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacgucugggagggcaugguggacggcugguucggguuccggcaccagaucugcgagggccgcgggcaggcggccggccuggagagcacgcaggccgccaucgaccagaucaacgggaagaugaaccggcugaugggcaagaccaucggcaaguuccaccagaucgugaacgaguucuccgaggucgaggggcgcauccaggaccucgagaaguacguggaggacaccaagaucgaccuguggagcuacaucggcgagcugcucguggcccuggagaaccaccacgcgaucgaccugaccgacuccgagaugaacaagcuguucgagaagacgaagaagcagaugcgggagaacgccgaggacauggggaacggcugcuucaagaucuaccacaagugcgacaacgccugcaucgggucgauccgcaacggcaucuacgaccgcgacgucuaccgggacgaggcccucaacaaccgcuuccacaucaagggcguggagcugaaguccggguacaaggacuggaucaucuggaucagcuccaccgagagcugcuuccuccugugcgucgcccugcucggcuucaucaugugggcgugccagaaggggaacauccgguccaacaucugcaucuga

SEQ ID NO: 12737 - RNA, 1701 nt, Artificial Sequence
  derived and/or modified CDS sequence (AUadapt) from InfluenzaA__AID70475__HA
augaagaccaucaucgcccugucguacaugcucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagaagucccagcaggccgugaucccgaacaucggcagccgcccccggguccgcaacauccccucccgggugucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacagcgcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacgucugggagggcaugguggacggcugguacggguuccggcaccagaacugcgagggccgcgggcaggcggccgaccucaagucggcccaggccgccaucgaccccaucaacggcaagcugaaccggcugauggggaagacgaucggcaaguuccaccagaucgagaaggaguucuccgagguggagggccgcauccaggaccuggagaaguacgucgaggacaccaagaucgaccuguggagcuacaacggggagcuccugguggcgcuggagaaccagcacgccaucgaccucaccgacuccgagaugaacaagguguucgagaagaccaagaagcagcugcgggagaacgccgaggacaugggcaacgggugcuucaagaucuaccacaagugcgacaacgccugcaucggcucgauccgcaacgggaucuacgaccacgacgucuaccgcaacgaggcccugaacaaccgguuccagaucaagggcguggagcucaaguccggcuacaaggacuggauccuguggaucagcuucgcgaucuccugcuuccugcucagcgucgccucccugggguucaucaugugggccuaccagaagggcaacauccgcugcaacaucugcaucuga

SEQ ID NO: 12738 - RNA, 1701 nt, Artificial Sequence
  derived and/or modified CDS sequence (AUadapt) from InfluenzaA__AID70476__HA
augaagaccaucaucgcccugucguacauccucugccugguguucgcccagaagcugcccggcaacgagaacuccaccgcgacgcucgggcugggccaccacgccgucccgaacgggaccaucgugaagaccaucaccaacgaccagaucgaggugacgaacgccaccgagcugguccagucguccagcaccggcgagaucugcaacucgccccaccagauccucgacggggagaacugcacccugaucgacgcccugcucggcgacccccagugcgacgacuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagaagucccagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacaaccugaagcucgccaccggcaugcggaacgugcccgagaagcagacccgcgggaucuucggcgccaucgccggguucaucgagaacggcugggagggcauggucgacgggugguacggcuuccggcaccagaacagcgaggggcgcggccaggcggccgaccugaaguccacccaggccgccaucgaccagaucaacgggaagcugaaccggcucaucggcaagacgaucgagaaguuccaccagaucgagaaggaguucucggagguggagggccgcauccaggggcgggagaaguacguggaggacaccaagaucgaccugugguccuacaucggcgaguucaucgucgcccuggagaaccagcacaccaucgaccucaccgacagcgagaugaacaagcuguucgagaagacgaagaagcagaugcgcgagaacgcggaggacauggggaacggcugcuucaagaucuaccacaagugcgacaacgccugcaucggguccauccgcaacggcaucuacgaccacgacguguaccgggacgaggcccugaacaaccgcuuccagaucaagggcguggagcucaagucgggguacaaggacuggauccuguggaucuccuucgccaucagcugcuuccugcucugcgucgcccugcugggcuucaucaugugggcgugccagaaggggaacauccggugcaacaucugcaucuga

SEQ ID NO: 12739 - RNA, 1701 nt, Artificial Sequence
  derived and/or modified CDS sequence (AUadapt) from InfluenzaA__AID70477__HA
augaagaccaucaucgcccugucguacauccucugccugguguucgcccagaagcugcccggcaacgacuccagcaccgggacgcucugccugggccaccacgcggucccgaacgggaccaucgugaagaccaucaccaacgaccagaucgaggugacgaacgccaccgagcugguccaguccagcuccaccggcgagaucugcaaccgcccccaccagauccucgacggggagaacugcacccugaucgacgcccugcucggcgacccccagugcgacggcuuccagaacaagaagugggaccuguucguggagcggucgaaggcccacuccaacugcuaccccuacgacgugccggacuacgccagccugcgcucccucgucgcgagcuccgggacgcuggaguucaacaacgagucguucaacuggaccggcgugacccagaacgggaccuccagcgccugcauccggcgcuccaacaacagcuucuucuccauccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcccaggcgucgggccggaucaccguguccacgaagaagucccagcaggccgugaucccgaacaucggcagccgcccccggguccgcaacauccccagccgggugucgaucuacuggaccaucgugaagcccggggagauccugcucaucaacuccaccggcaaccugaucgccccgcgcggguacuucaagauccggagcggcaaguccagcaucaugcgcuccgacgcccccaucggcaagugcuacucggccugcaucacccccaacggguccauccccaacgacaagccguuccagaacgucaaccggaucacguacggcgcgugcccccgcuacgugaagcagcacccccugaagcucgccaccgggaugcggaacgugcccgagaagcagacccgcggcaucuucggggccaucgccggcuucaucgagaacggcugggaggggauggucgacggcugguacggguuccggcaccagaucugcgagggccgcgggcaggccgcggaccucaagagcacccaggccgccaucgaccagaucaacggcaagcugaaccggcucaucggcaagacgaucgagaaguuccaccagaucgagaaggaguucuccgagguggaguggcgcauccaggggcuggagaaguacguggaggacaccaaggucgaccuguggagcuacaacggcgagcucaucguggcccuggagaaccaccacaccaucgaccugaccgacuccgagaugaacaagcuguucgagaagacgaagaagcagaugcgggagaacgccgaggacauggggaacggcugcuucaagaucuaccugaagugcgacaacgcgugcaucgggucgauccgcaacggcaucuacgaccacgacguguaccgcgacgaggcccugaacaaccgguuccagaucaagggcgucgagcucaaguccggguacaaggacuggauccuguggaucagcuucaccgaguccugcuuccugcucagcguggcccugcugggcuucaucaugugggccugccagaaggggaacauccgcugcaacaucugcaucuga

SEQ ID NO: 12740 - RNA, 1701 nt, Artificial Sequence
  derived and/or modified CDS sequence (AUadapt) from InfluenzaA__AID70478__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagaagucccagcaggccgugaucccgaacaucggcagccgcccccggguccgcaacauccccucccgggugucgaucuacuggaccaucgugaagcccggcgacauccugcucaucaacuccaccgggaaccugaucgccccgcgcggcuacuucaagauccggagcgggaaguccucgaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacugcgaggggcgcggccaggcggccgaccuggagagcacgcaggccgccaucgaccagaucaacgggaagaugaaccggcugaugggcaagaccaucgagaaguuccaccagaucgagaaggaguucuccgagguggagggccgcauccaggggcgggagaaguacguggaggacaccaagaucgaccucuggucguacaacggcgagcugcuggucgaccucgagaaccagcacaccaucgaccugacggacuccgagaugaacaagguguucgagaagaccaagaagcagaugcgcgagaacgccgaggacauggggaacggcugcuucaagaucuaccacaagugcgacaacgcgugcaucgggagcauccgcaacggcaucuacgaccacgacguguaccgggacgaggcccugaacaaccgcuuccagaucaagggcgucgagcucaaguccggguacaaggacuggauccaguggaucucguucaccaucuccugcuuccugcugugcgugagccuccugggcuucaucaugugggccugccagaaggggaacauccggugcaacaucugcaucuga

SEQ ID NO: 12741 - RNA, 1701 nt, Artificial Sequence; identical to SEQ ID NO: 10285
  derived and/or modified CDS sequence (AUadapt) from InfluenzaA__AID70632__HA

SEQ ID NO: 12742 - RNA, 1683 nt, Artificial Sequence
  derived and/or modified CDS sequence (AUadapt) from InfluenzaA__AID70634__HA
augaauacccaaauccugguguucgcccucaucgccaucauccccaccaacgcggacaagaucugccugggccaccacgccgucagcaacgggacgaaggugaacacccugaccgagcgcggcguggaggucgugaaugccaccgagacgguggagcggaccaacaucccgcgcaucugcuccaaggggaagcggaccgucgaccucggccagugcgggcugcugggcaccaucacgggcccgccccagugcgaccaguuccucgaguucagcgccgaucugaucaucgagcgccgggagggguccgacgugugcuaccccggcaaguucgugaacgaggaagcccugcgccagauccuccgggagagcgggggcaucgacaaggaggcgaugggguucaccuacuccggcauccgcaccaauggcgccaccagcgccugccggcgcuccgggagcuccuucuacgccgagaugaaguggcugcugagcaacacggacaacgcggccuuuccgcagaugaccaaguccuacaagaacacccgcaagagccccgcccucaucgucuggggcauccaccacuccgugagcaccgccgagcagacgaagcuguacggguccggcaacaagcuggugaccgucggcagcuccaauuaccagcagagcuucgugcccucccccggggcccggccccaggugaacggccucagcgggcggaucgacuuccacuggcugaugcugaaccccaaugacaccgucaccuucagcuucaacggcgcguucaucgcccccgaccgcgccuccuuccuccggggcaaaagcauggggauccaguccggcguccagguggaugccaacugcgagggggacugcuaccacagcggcgggacgaucaucuccaaccugcccuuccagaacaucgauagccgcgccgugggcaagugcccgcgguacgugaagcagcgcucccugcuccuggcgaccgggaugaagaacgugcccgagauccccaagggccggggccuguucggggccaucgccggcuucaucgagaacgggugggagggccucaucgacgggugguacggcuuucgccaccagaacgcccagggcgaggggaccgccgcggacuacaagagcacccaauccgccaucgaccagaucacgggcaagcugaaccggaucaucgagaagaccaaccagcaguucgagcugaucgauaacgaguucaacgaggucgagaagcagaucagcaacgugaucaacuggacccgcgacuccaucaccgagguguggagcuacaaugccgagcuccuggucgccauggagaaccagcacacgaucgaccuggccgacuccgagauggacaaacucuacgagcgcgugaagcggcagcugcgcgagaacgcggaggaggacgggaccggcugcuuugagaucuuccacaagugcgacgacgacugcauggccagcauccggaacaauaccuacgaccacuccaaguaccgcgaggaggccaugcagaaccggauccagaucgaccccgucaagcugagcuccggcuacaaggacgugauccucugguuuagcuucggggccuccugcuucauccugcuggcgaucgugaugggccucgucuucaucugcgugaagaacgggaacaugcgcugcaccaucugcaucuga

SEQ ID NO: 12743 - RNA, 1701 nt, Artificial Sequence
  derived and/or modified CDS sequence (AUadapt) from InfluenzaA__AIF72902__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgaggucgagggccgcauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcgcugcucggcuucaucaugugggccugccagaaggggaacauccgcugcaacaucugcaucuga

SEQ ID NO: 12744 - RNA, 1701 nt, Artificial Sequence
  derived and/or modified CDS sequence (AUadapt) from InfluenzaA__AIF72903__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugguggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgaggucgagggccgcauccaggaccuggagaaguacguggaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacgucuaccgcgacgaggcccucaacaaccgguuccagaucaaggggguggagcugaaguccggcuacaaggacugggugcuguggaucagcuucgccaucuccugcuuccuccugugcgucgcgcugcucggcuucaucaugugggccugccagaaggggaacauccgcugcaacaucugcaucuga

SEQ ID NO: 12745 - RNA, 1701 nt, Artificial Sequence
  derived and/or modified CDS sequence (AUadapt) from InfluenzaA__AIF72904__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaacaacgagucguucaacuggacgggggugacccagaacggcaccuccagcgccugcauccggcgcuccaacaacucguucuucucccggcugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcgcaucaccguguccaccaagcggucgcagcaggccgugaucccgaacaucggcagccgcccccggguccgcaacauccccucccggaucucgaucuacuggacgaucgugaagcccggcgacauccugcucaucaacuccaccgggaaccugaucgccccgcgcggcuacuucaagauccggagcgggaaguccucgaucaugcgcuccgacgcgcccaucggcaagugcaacagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgccaucgccggguucaucgagaacggcugggagggcaugauggacgggugguacggcuuccggcaccagaacuccgaggggcgcggccaggcggccgaccugaaguccacccaggccgccaucgaccagaucaacgggaagcugaaccggcucaucggcaagacgaacgagaaguuccaccagaucgagaaggaguucuccgagguggagggccgcauccaggaccuggagaaguacgucgaggacaccaagaucgaccuguggagcuacaacgccgagcuccugguggcgcuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggucgauccggaacggcaccuacgaccacgacguguaccgcgacgaggcccucaacaaccgguuccagaucaagggggucgagcugaaguccggcuacaaggacugggugcuguggaucagcuucgccaucuccugcuuccuccugugcguggcgcugcucggcuucaucaugugggccugccagaaggggaacauccgcugcaacaucugcaucuga

SEQ ID NO: 12746 - RNA, 1701 nt, Artificial Sequence
  derived and/or modified CDS sequence (AUadapt) from InfluenzaA__AIF72905__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacucgccccaccagauccucgacggcgagaacugcacccugaucgacgcccugcucggggacccccagugcgacggcuuccagaacaagaagugggaccuguucguggagcgcagccgggcguacuccaacugcuaccccuacgacgugccggacuacgccucgcugcgcucccucgucgccagcuccggcacccuggaguucaagaacgagucguucaacuggacgggggugacccagaacggcaccuccagcgccugcauccggcgcuccaacaacucguucuucucccggcugaacuggcucacccacagcaacuucaaguaccccgcgcugaacgugacgaugcccaacaacgagcaguucgacaagcuguacaucuggggcguccaccaccccgggaccgacaaggaccagaucuuccucuacgcccaggccuccgggcgcaucaccgugucgaccaagcggucgcagcaggccgugaucccgaacaucggcucccgcccccggguccgcaacauccccagccggaucuccaucuacuggacgaucgugaagcccggcgacauccugcugaucaacucgaccgggaaccucaucgccccgcgcggcuacuucaagauccgguccgggaaguccuccaucaugcgcagcgacgcgcccaucggcaagugcaacuccgagugcaucacccccaacggcucgauccccaacgacaagccguuccagaacgugaaccggaucaccuacggggccugcccccgcuacgucaagcaguccacgcugaagcuggccaccggcaugcggaacgugcccgagaagcagacccgcgggaucuucggcgccaucgccggguucaucgagaacggcugggagggcaugauggacgggugguacggcuuccggcaccagaacagcgaggggcgcggccaggcggccgaccucaaguccacccaggccgccaucgaccagaucaacgggaagcugaaccggcugaucggcaagacgaacgagaaguuccaccagaucgagaaggaguucucggagguggagggccgcauccaggaccucgagaaguacgucgaggacaccaagaucgaccugugguccuacaacgccgagcugcucguggcgcuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgccugcaucggguccauccggaacggcaccuacgaccacgacguguaccgcgacgaggcccugaacaaccgguuccagaucaagggggucgagcucaagucgggcuacaaggacuggauccuguggaucuccuucgccaucagcugcuuccugcucugcguggcgcugcugggcuucaucaugugggccugccagaaggggaacauccgcugcaacaucugcaucuga

SEQ ID NO: 12747 - RNA, 1701 nt, Artificial Sequence; identical to SEQ ID NO: 3656
  derived and/or modified CDS sequence (AUadapt) from InfluenzaA__AIF72906__HA

SEQ ID NO: 12748 - RNA, 1701 nt, Artificial Sequence; identical to SEQ ID NO: 3656
  derived and/or modified CDS sequence (AUadapt) from InfluenzaA__AIF72907__HA

SEQ ID NO: 12749 - RNA, 1701 nt, Artificial Sequence; identical to SEQ ID NO: 3656
  derived and/or modified CDS sequence (AUadapt) from InfluenzaA__AIF72908__HA

SEQ ID NO: 12750 - RNA, 1701 nt, Artificial Sequence
  derived and/or modified CDS sequence (AUadapt) from InfluenzaA__AIF72909__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcgccggggagaucugcgacggcccccaccagauccucgacggggagaacugcacccugaucgacgcccugcucggcgacccccagugcgacggcuuccagaacaagaagugggaccuguucguggagcgcucccgggcguacucgaacugcuaccccuacgacgugccggacuacgccucccugcgcucgcucgucgccuccagcgggacccuggaguucaacaacgaguccuucaacuggacgggcaccacccagaacgggaccucguccgccugcauccggcgcagcaacaacuccuucuucucgcggcugaacuggcucacgcaccugaacuucaaguaccccgcgcugaacgugaccaugcccaacaacgagcaguucgacaagcucuacaucuggggcgugcaccaccccgggaccgacaaggaccagaucuuccuguacgcccaggccuccggccgcaucaccgucucgacgaagcggucccagcaggccgugaucccgaacaucggcagccgcccccgggugcgcaacauccccucgcggaucuccaucuacuggaccaucgucaagcccggggacauccugcucaucaacucgaccggcaaccugaucgccccgcgcggguacuucaagauccgguccggcaagagcuccaucaugcgcucggacgcgcccaucggcaagugcaacuccgagugcaucacccccaacgggagcauccccaacgacaagccguuccagaacgugaaccggaucacguacggcgccugcccccgcuacgugaagcaguccacccugaagcucgccaccgggaugcggaacguccccgagaagcagacccgcggcaucuucggggccaucgccggcuucaucgagaacggcugggaggggaugguggacggcugguacggguuccggcaccagaacucggagggccgcgggcaggcggccgaccugaaguccacgcaggccgccaucgaccagaucaacggcaagcugaaccggcucaucggcaagaccaacgagaaguuccaccagaucgagaaggaguucucggagguggaggggcgcauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagucgggcuacaaggacuggauccuguggaucuccuucgccaucagcugcuuccugcugugcguggcgcugcucggguucaucaugugggccugccagaagggcaacauccgcugcaacaucugcaucuga

SEQ ID NO: 12751 - RNA, 1701 nt, Artificial Sequence; identical to SEQ ID NO: 3656
  derived and/or modified CDS sequence (AUadapt) from InfluenzaA__AIF72910__HA

SEQ ID NO: 12752 - RNA, 1701 nt, Artificial Sequence; identical to SEQ ID NO: 3656
  derived and/or modified CDS sequence (AUadapt) from InfluenzaA__AIF72911__HA

SEQ ID NO: 12753 - RNA, 1701 nt, Artificial Sequence; identical to SEQ ID NO: 12743
  derived and/or modified CDS sequence (AUadapt) from InfluenzaA__AIF72912__HA

SEQ ID NO: 12754 - RNA, 1701 nt, Artificial Sequence; identical to SEQ ID NO: 3656
  derived and/or modified CDS sequence (AUadapt) from InfluenzaA__AIF72913__HA

SEQ ID NO: 12755 - RNA, 1701 nt, Artificial Sequence
  derived and/or modified CDS sequence (AUadapt) from InfluenzaA__AIF72914__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcgggggcaagagcuccaucaugcggucggacgcccccaucggcaagugcaacuccgagugcaucacccccaacgggagcauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggccgggggcaggccgcggaccugaaguccacgcaggccgccaucgaccagaucaacggcaagcugaaccgccucaucggcaagaccaacgagaaguuccaccagaucgagaaggaguucuccgaggucgaggggcggauccacgaccuggagaaguacguggaggacacccuguucgaccucuggguguacaacucggagcugcuggucgcccuccagaaccagcacaccaucgaccugcccgacuccgagaugaacaagcuguucgagaagacgaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcguggagcugaaguccggcuacaaggacuggauccucuggaucagcuucgccaucuccugcuuccugcugugcgucgcccuccugggguucaucaugugggccugccagaagggcaacauccggugcaacaucugcaucuga

SEQ ID NO: 12756 - RNA, 1701 nt, Artificial Sequence
  derived and/or modified CDS sequence (AUadapt) from InfluenzaA__AIF72915__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccuccagauccuggacggcgagaacugcacccugaucgacgcccuccugggggacccccagugcgacggcuuccagaacaagaagugggaccuguucguggagcgcagcaaggccuacuccaacugcuaccccuacgacgugccggacuacgcgucgcuccggucccuggucgccagcuccggcacgcuggaguucaacaacgagucguucaacuggaccggggugacccagaacggcaccuccagcgccugcauccgccgguccaacaacucguucuucucccgccucaacuggcugacgcaccugaacuucaaguaccccgcccucaacgugaccaugcccaacaacgagcaguucgacaagcuguacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccuccugaucaacuccaccgggaaccugaucgccccgcggggcuacuucaagauccgcagcgggaaguccucgaucaugcgguccaacgcccccaucggcaagugcaacagcgagugcaucacccccaacggcuccauccccaacgacaagccguuccagaacgugaaccgcaucacguacggggcgugcccccgguacgucaagcagaacacccucaagcuggccaccggcaugcgcaacgugcccgagaagcagacccgggggaucuucggcgccaucgccggguucaucgagaacggcugggagggcaugguggacgggugguacggcuuccgccaccagaacucggaggggcggggccaggccgcggaccugaaguccacgcaggccgccaucgaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugacggacucggagaugaacaagcuguucgagaagaccaagaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucuccuucgccaucagcugcuuccugcugugcguggcccuccugggcuucaucaugugggcgugccagaaggggaacauccggugcaacaucugcaucuga

SEQ ID NO: 12757 - RNA, 1701 nt, Artificial Sequence; identical to SEQ ID NO: 3656
  derived and/or modified CDS sequence (AUadapt) from InfluenzaA__AIF72916__HA

SEQ ID NO: 12758 - RNA, 1701 nt, Artificial Sequence
  derived and/or modified CDS sequence (AUadapt) from InfluenzaA__AIF72917__HA
augaagaccaucaucgcccugucguacauccucugccugguguucgcccagaagcugccccgcaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcgacucgccccaccagauccucgacggggagaacugcacccugaucgacgcccugcucggcgacccccagugcgacggguuccagaacaagaagugggaccuguucguggagcggagcaaggccuacuccaacugcuaccccuacgacgugccggacuacgcgucgcugcgcucccucgucgccagcuccggcacgcuggaguucaagaacgagucguucaacuggaccggcgugacccagaacgggaccuccucggccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucgggccgcaucaccguguccacgaagcggagccagcaggccgugaucccgaacaucgggucgcgcccccggguccgcaacauccccucccggaucagcaucuacuggaccaucgugaagcccggcgacauccugcucaucaacuccaccggcaaccugaucgccccgcgcggguacuucaagauccggucgggcaaguccucgaucaugcgcuccgacgcccccaucgggaagugcaacagcgagugcaucacccccaacggcuccauccccaacgacaagccguuccagaacgugaaccggaucacguacggcgcgugcccccgcuacgucaagcagaacacccugaagcucgccaccgggaugcggaacgugcccgagaagcagacccgcggcaucuucggggccaucgccggcuucaucgagaacgggugggagggcaugguggacggcugguacggguuccggcaccagaacucggagggccgcgggcaggccgcggaccugaaguccacgcaggccgccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacucggagaugaacaagcuguucgagaagaccaagaagcagcugcgcgagaacgcggaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggcgugccagaagggcaacauccgcugcgacaucugcaucuga

SEQ ID NO: 12759 - RNA, 1683 nt, Artificial Sequence
  derived and/or modified CDS sequence (AUadapt) from InfluenzaA__AIG44693__HA
auggagaccgccucgcugaucaccauccuccugguggucacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgggggccgcgaguggucguacaucguggagcggcccuccgccgucaacggccugugcuaccccgggaacguggagaaccuggaggagcuccgcucgcuguucuccucggcccgguccuaccagcgcauccagaucuucccggacaccaucuggaacgugucguacuccggcaccucgaaggccugcuccgacucguucuaccgguccaugcgcuggcugacccagaaggacaacgcguaccccauccaggacgcccaguacaccaacaaccaggagaagaacauccucuucaugugggggaucaaccacccgcccaccgacacggcccagaccaaccuguacacccggaccgacacgaccaccucggucgccaccgaggagaucaaccgcacguucaagccccugaucggcccccggccccucgugcacgggcugaugggccgcaucaacuacuacugguccgugcugaagcccggccagacccuccggaucaagagcaacgggaaccugaucgcgccgugguacggccacauccugucggggaagucccacggccgcauccucaagaccgaccugaagcggggcaacugcaccguccagugccagacggagaagggcgggcugaacaccacccuccccuuccagaacgugucgaaguacgccuucgggaacugcuccaaguacaucggcaucaagucgcugaagcuggccguggggcuccgcaacguccccucccggucgucccgcggccuguucggcgccaucgccggguucaucgagggcggguggucgggccugguggcggggugguacggcuuccagcacuccaacgaccagggcguggggauggccgccgaccgggacucgacccagaaggccaucgacaagaucacguccaaggucaacaacaucguggacaagaugaacaagcaguacgagaucaucgaccacgaguucucggagguggagacccgccucaacaugaucaacaacaagaucgacgaccagauccaggacaucugggccuacaacgcggagcugcugguccuccuggagaaccagaagacccuggacgagcacgacgccaacgugaacaaccucuacaacaaggugaagcgggcccugggcuccaacgccgucgaggacgggaagggcugcuucgagcuguaccacaagugcgacgaccagugcauggagaccauccgcaacgggacguacaaccggcgcaaguaccaggaggagucgaagcucgagaagcagaagaucgagggcgugaagcuggaguccgagggcaccuacaagauccugaccaucuacucgaccgucgccuccucgcucgugaucgcgaugggguucgccgccuuccuguucugggccauguccaacggcagcugccgcugcaacaucugcaucuga

SEQ ID NO: 12760 - RNA, 1701 nt, Artificial Sequence; identical to SEQ ID NO: 7227
  derived and/or modified CDS sequence (AUadapt) from InfluenzaA__AIJ10728__HA

SEQ ID NO: 12761 - RNA, 1701 nt, Artificial Sequence
  derived and/or modified CDS sequence (AUadapt) from InfluenzaA__AIJ10729__HA
augaagaccaucaucgcccugucguacauccucugccugguguucgcccagaagcugcccggccacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccagcaucaugcgguccgacgcccccaucggcaagugcaacucggcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagaccaaggggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgggagaacgccgaggacauggggaacggcugcuucaagaucuaccacaagugcgacaacgccugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 12762 - RNA, 1701 nt, Artificial Sequence; identical to SEQ ID NO: 7227
  derived and/or modified CDS sequence (AUadapt) from InfluenzaA__AIJ10730__HA

SEQ ID NO: 12763 - RNA, 1701 nt, Artificial Sequence; identical to SEQ ID NO: 7227
  derived and/or modified CDS sequence (AUadapt) from InfluenzaA__AIJ10731__HA

SEQ ID NO: 12764 - RNA, 1701 nt, Artificial Sequence
  derived and/or modified CDS sequence (AUadapt) from InfluenzaA__AIJ10732__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuuccgguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaacucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 12765 - RNA, 1701 nt, Artificial Sequence
  derived and/or modified CDS sequence (AUadapt) from InfluenzaA__AIJ10733__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacaacucguucuucucccgccugaacuggcucacgcaccugaacuuccgguaccccgcccugaacgugaccaugcccaacaacgagcaguucgacaagcucuacaucuggggcguccaccaccccgggaccgacaaggaccagaucuuccuguacgcgcaggccagcgggcgcaucaccguguccacgaagcggucgcagcaggccgugaucccgaacaucggcucgcgcccccggguccgcaacauccccucccgggugagcaucuacuggaccaucgugaagcccggcgacauccugcucaucaacuccaccgggaaccugaucgccccgcgcggcuacuucaagauccggucggggaaguccagcaucaugcgcuccgacgcccccaucggcaagugcaagucggcgugcaucacccccaacggcuccauccccaacgacaagccguuccagaacgucaaccggaucacguacggggccugcccccgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacucggaggggcgcggccaggcggccgaccugaaguccacgcaggccgccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccggaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcgcugcucggcuucaucaugugggccugccagaaggggaacauccgcugcaacaucugcaucuga

SEQ ID NO: 12766 - RNA, 1701 nt, Artificial Sequence
  derived and/or modified CDS sequence (AUadapt) from InfluenzaA__AIJ10734__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagucguccagcaccggcgagaucugcaacucgccccaccagauccucgacggggagaacugcacccugaucgacgcccugcucggcgacccccagugcgacggguuccagaacaagaagugggaccuguucguggagcgcucgaaggcccacuccaacugcuaccccuacgacgugccggacuacgcgagccugcggucccucgucgccucguccggcacgcuggaguucaacaacgagagcuucaacuggaccggcgugacccagaacgggaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcucgcagcaggccgugaucccgaacaucgggucgcggccccgcguccggaacauccccucccgcaucagcaucuacuggaccaucgugaagcccggcgacauccugcucaucaacuccaccggcaaccugaucgccccgcggggguacuucaagauccgcucgggcaaguccagcaucaugcgguccgacgcccccaucgggaagugcaacucgacgugcaucacccccaacggcuccauccccaacgacaagccguuccagaacgugaaccgcaucaccuacggcgcgugcccccgguacgucaagcagaacacccugaagcucgccaccgggaugcgcaacgugcccgagaagcagacgcggggcaucuucggggccaucgccggcuucaucgagaacgggugggagggcaugguggacggcugguacggguuccgccaccagaacucggagggccgggggcaggccgcggaccugaaguccacccaggccgccaucgaccagaucaacggcaagcugaaccgccucaucgggaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 12767 - RNA, 1701 nt, Artificial Sequence
  derived and/or modified CDS sequence (AUadapt) from InfluenzaA__AIJ10735__HA
augaagaccaucaucgcccugucguacauccucugccugaucuucgcccagaagcugcccgagaacgacaacuccaccgcgacgcucugccugggccaccacgccgugccgaacgggaccaucgucaagaccaucaccaacgaccagaucgaggugacgaacgccaccgagcuggugcagucguccagcaccggcgagaucugcaacucgccccaccagauccucgacggggagaacugcacccugaucgacgcccugcucggcgacccccagugcgacggguuccagaacaagaagugggaccuguucgucgagcgcucgaaggcccacuccaacugcuaccccuacgacgugccggacuacgcgagccugcggucccucguggccucguccggcacgcuggaguucaacaacgagagcuucaacuggaccggcgucacccagaacgggaccuccucggccugcauccgccgguccaacaacucguucuucucccgccugaacuggcucacgcaccugaacuucaaguaccccgcccugaacgugaccaugcccaacaacgagcaguucgacaagcucuacaucuggggcgugcaccaccccgggaccgacaaggaccagaucuuccuguacgcgcaggccagcggccggaucaccgucuccacgaagcgcucgcagcaggccgugaucccgaacaucgggucgcggccccgcgugcggaacauccccucccgcgucagcaucuacuggaccaucgugaagcccggcgacauccugcucaucaacuccaccggcaaccugaucgccccgcggggguacuucaagauccgcucgggcaaguccagcaucaugcgguccgacgcccccaucgggaagugcaacucgacgugcaucacccccaacggcuccauccccaacgacaagccguuccagaacgugaaccgcaucaccuacggcgcgugcccccgguacgucaagcagaacacccugaagcucgccaccgggaugcgcaacgugcccgagaagcagacgcggggcaucuucggggccaucgccggcuucaucgagaacgggugggagggcaugguggacggcugguacggguuccgccaccagaacucggagggcaaggggcaggccgcggaccugaaguccacccaggccgccaucgaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggguacaaggacuggauccuguggaucuccuucgccaucagcugcuuccuccugugcguggcccugcucggcuucaucaugugggcgugccagaagggcaacauccgcugcaacaucugcaucuga

SEQ ID NO: 12768 - RNA, 1701 nt, Artificial Sequence
  derived and/or modified CDS sequence (AUadapt) from InfluenzaA__AIJ10736__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucgaccaucggggagaucugcgacagcccccaccagauccucgacggcgagaacugcacccugaucgacgcccugcucggggacccccagugcgacggcuuccagaacaagaagugggaccuguucguggagcggucgaaggccuacuccaacugcuaccccuacgacgugccggacuacgcgagccugcgcucccucgucgccucguccggcacgcuggaguucaacaacgagagcuucaacuggaccggggugacccagaacggcaccuccucggccugcauccggcgcuccaacaacagcuucuucucccggcugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcagucguccgggcgcaucaccgugagcacgaagcggucccagcaggccgugaucccgaacaucggcucgcgcccccggauccgcaacauccccagccggaucuccaucuacuggaccaucgucaagcccggcgacauccugcucaucaacucgaccgggaaccugaucgccccgcgcggcuacuucaagauccgguccgggaaguccuccaucaugcgcagcgacgcccccaucggcaagugcaaguccgagugcaucacccccaacggcucgauccccaacgacaagccguuccagaacgugaaccggaucacguacggggccugcccccgcuacgugaagcaguccacccugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacgcaggcggccaucgaccagaucaacgggaagcugaaccggcucaucggcaagaccaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12769 - RNA, 1701 nt, Artificial Sequence
  derived and/or modified CDS sequence (AUadapt) from InfluenzaA__AIJ10737__HA
augaagaccaucaucgcccugucguacauccucugccugguggucgcccagaagcugcccggcaacgacaacuccaccgcgacgcucugccuggggcaccacgccgugccgaacggcaccaucgugaagaccaucaccaacgaccgcaucgaggucacgaacgccaccgagcuggugcagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgucccggacuacgcgucccugcgcagccucguggccuccucgggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcgcaguccucggggcgcaucaccguguccaccaagcggagccagcaggccgucaucccgaacaucggcucgcgcccccggauccgcaacauccccucccggaucagcaucuacuggacgaucgugaagcccggcgacauccugcucaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgucaagcagagcacgcugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12770 - RNA, 1701 nt, Artificial Sequence
  derived and/or modified CDS sequence (AUadapt) from InfluenzaA__AIJ10738__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcacuucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12771 - RNA, 1701 nt, Artificial Sequence; identical to SEQ ID NO: 9698
  derived and/or modified CDS sequence (AUadapt) from InfluenzaA__AIJ10740__HA

SEQ ID NO: 12772 - RNA, 1701 nt, Artificial Sequence; identical to SEQ ID NO: 9698
  derived and/or modified CDS sequence (AUadapt) from InfluenzaA__AIJ10741__HA

SEQ ID NO: 12773 - RNA, 1701 nt, Artificial Sequence
  derived and/or modified CDS sequence (AUadapt) from InfluenzaA__AIJ10742__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucggggcgcaucaccguggccaccaagcggucccagcaggccgugaucccgaacaucggcagccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggcgugcccccgcuacgugaagcaguccacgcugaagcucgccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgcggaccugaaguccacccaggccgccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgcggaggacauggggaacggcugcuucaagaucuaccacaagugcgacaacgccugcaucggguccauccggaacggcaccuacgaccacgacguguaccgcgacgaggcccucaacaaccgguuccagaucaagggggucgagcucaagucgggcuacaaggacuggauccuguggaucuccuucgccaucagcugcuuccugcugugcguggcccugcucggcuucaucaugugggcgugccagaaggggaacauccgcugcaacaucugcaucuga

SEQ ID NO: 12774 - RNA, 1701 nt, Artificial Sequence
  derived and/or modified CDS sequence (AUadapt) from InfluenzaA__AIJ10743__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucggggcgcaucaccguguccaccaagcggagccagcaggccgugaucccgaacaucggcucgcgcccccggauccgcaacauccccucccggaucagcaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaucaagaucgaccuguggucguacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcacguacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12775 - RNA, 1701 nt, Artificial Sequence
  derived and/or modified CDS sequence (AUadapt) from InfluenzaA__AIJ10744__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccucggggcgcaucaccguguccaccaagcggagccagcaggccgugaucccgaacaucggcucgcgcccccggauccgcaacauccccucccggaucagcaucuacuggacgaucgucaagcccggcgacauccugcucaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcagcggacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 12776 - RNA, 1701 nt, Artificial Sequence; identical to SEQ ID NO: 162
  derived and/or modified CDS sequence (AUadapt) from InfluenzaA__AIJ10745__HA

SEQ ID NO: 12777 - RNA, 1701 nt, Artificial Sequence
  derived and/or modified CDS sequence (AUadapt) from InfluenzaA__AIJ10747__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacgacuuccagaacaagaagugggaccuguucguggagcgguccaaggccuacucgaacugcuaccccuacgacgugccggacuacgcgucccugcgcagccucgucgccuccucgggcacccuggaguucaacaacgagaacuucaacuggacgggcgugacccagaacgggaccuccagcgccugcauccggcgcuccaacaacucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccgcaucaccgugucgaccaagcggucccagcaggccgugaucccgaacaucgggagccgcccccggauccgcaacauccccucgcggaucuccaucuacuggacgaucgucaagcccggcgacauccugcucaucaacagcaccggcaaccugaucgccccgcgcggguacuucaagauccgguccggcaagucguccaucaugcgcagcgacgcccccaucgggaagugcaaguccgagugcaucacccccaacggcucgauccccaacgacaagccguuccagaacgugaaccggaucaccuacggcgccugcccccgcuacgugaagcaguccacgcugaagcucgcgaccgggaugcggaacguccccgagaagcagacccgcggcaucuucggggccaucgccggcuucaucgagaacgggugggagggcaugguggacggcugguacggguuccggcaccagaacagcgagggccgcgggcaggccgccgaccugaaguccacccaggcggccaucgaccagaucaacggcaagcugaaccggcucaucgggaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcucaagucgggguacaaggacuggauccuguggaucuccuucgccaucagcugcuuccugcugugcguggcccugcucggcuucaucaugugggccugccagaagggcaacauccgcugcaacaucugcaucuga

SEQ ID NO: 12778 - RNA, 1701 nt, Artificial Sequence; identical to SEQ ID NO: 12777
  derived and/or modified CDS sequence (AUadapt) from InfluenzaA__AIJ10748__HA

SEQ ID NO: 12779 - RNA, 1701 nt, Artificial Sequence
  derived and/or modified CDS sequence (AUadapt) from InfluenzaA__AIJ10750__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucauccgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacguguaccgcgacgaggcccucaacaaccgguuccagaucaagggggucgagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 12780 - RNA, 1701 nt, Artificial Sequence
  derived and/or modified CDS sequence (AUadapt) from InfluenzaA__AIJ10752__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacauccccagccggaucuccaucuacuggacgaucgucaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagagcggcuacaaggacuggauccuguggaucuccuucgccaugagcugcuuccugcugugcguggcccugcucggcuucaucaugugggccugccagaaggggaacauccgcugcaacaucugcaucuga

SEQ ID NO: 12781 - RNA, 1701 nt, Artificial Sequence
  derived and/or modified CDS sequence (AUadapt) from InfluenzaA__AIJ10753__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacaacucguucuucucccgccugaacuggcucacccaccugaacuucaaguaccccgcccugaacgugaccaugcccaacaacgagcaguucgacaagcucuacaucuggggcguccaccaccccgggacggacaaggaccagaucuuccuguacgcgcagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagaagcagacccggggcaucuucggggccaucgccggcuucaucgagaacggcugggaggggaugauggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 12782 - RNA, 1701 nt, Artificial Sequence; identical to SEQ ID NO: 162
  derived and/or modified CDS sequence (AUadapt) from InfluenzaA__AIJ10754__HA

SEQ ID NO: 12783 - RNA, 1701 nt, Artificial Sequence
  derived and/or modified CDS sequence (AUadapt) from InfluenzaA__AIJ10755__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccagucggccaucgaccagaucaacggcaagcugaaccgccucaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 12784 - RNA, 1701 nt, Artificial Sequence; identical to SEQ ID NO: 162
  derived and/or modified CDS sequence (AUadapt) from InfluenzaA__AIJ10756__HA

SEQ ID NO: 12785 - RNA, 1701 nt, Artificial Sequence
  derived and/or modified CDS sequence (AUadapt) from InfluenzaA__AIJ10757__HA
augaagaccaucaucgcccugucguacauccucugccuggugaucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 12786 - RNA, 1701 nt, Artificial Sequence
  derived and/or modified CDS sequence (AUadapt) from InfluenzaA__AIJ10758__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccucgggccggaucaccgugagcaccaagcgcucccagcaggccgugaucccgaacaucggcucgcggccccgcauccggaacauccccucccgcaucagcaucuacuggaccaucgucaagcccggggacauccugcugaucaacuccacgggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugauggacggcugguacggguuccgccaccagaacuccgagggccgggggcaggccgcggaccucaagucgacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 12787 - RNA, 1701 nt, Artificial Sequence; identical to SEQ ID NO: 162
  derived and/or modified CDS sequence (AUadapt) from InfluenzaA__AIJ10759__HA

SEQ ID NO: 12788 - RNA, 1701 nt, Artificial Sequence
  derived and/or modified CDS sequence (AUadapt) from InfluenzaA__AIJ10760__HA
augaagaccaucaucgcccugucguacauccucugccuggugaucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagucgggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 12789 - RNA, 1701 nt, Artificial Sequence
  derived and/or modified CDS sequence (AUadapt) from InfluenzaA__AIJ10761__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccggaacgaggcccucaacaagcgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 12790 - RNA, 1701 nt, Artificial Sequence; identical to SEQ ID NO: 12137
  derived and/or modified CDS sequence (AUadapt) from InfluenzaA__AIJ10762__HA

SEQ ID NO: 12791 - RNA, 1701 nt, Artificial Sequence; identical to SEQ ID NO: 12137
  derived and/or modified CDS sequence (AUadapt) from InfluenzaA__AIJ10763__HA

SEQ ID NO: 12792 - RNA, 1701 nt, Artificial Sequence; identical to SEQ ID NO: 12137
  derived and/or modified CDS sequence (AUadapt) from InfluenzaA__AIJ10764__HA

SEQ ID NO: 12793 - RNA, 1701 nt, Artificial Sequence; identical to SEQ ID NO: 12137
  derived and/or modified CDS sequence (AUadapt) from InfluenzaA__AIJ10765__HA

SEQ ID NO: 12794 - RNA, 1701 nt, Artificial Sequence; identical to SEQ ID NO: 12137
  derived and/or modified CDS sequence (AUadapt) from InfluenzaA__AIJ10766__HA

SEQ ID NO: 12795 - RNA, 1701 nt, Artificial Sequence; identical to SEQ ID NO: 12137
  derived and/or modified CDS sequence (AUadapt) from InfluenzaA__AIJ10767__HA

SEQ ID NO: 12796 - RNA, 1701 nt, Artificial Sequence
  derived and/or modified CDS sequence (AUadapt) from InfluenzaA__AIJ10768__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacauccccgagaagcagacccggggcaucuucggggccaucgccggcuucaucgagaacggcugggaggggauggucgacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgugcugcucggguucaucaugugggccugccagaagggcaacauccggugcaacaucugcaucuga

SEQ ID NO: 12797 - RNA, 1701 nt, Artificial Sequence
  derived and/or modified CDS sequence (AUadapt) from InfluenzaA__AIJ10769__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccaguccggcaagucguccaucaugcgcagcgacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgggagaacgcggaggacaugggcaacgggugcuucaagaucuaccacaagugcgacaacgccugcaucggcuccauccgcaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggugcugcucggguucaucaugugggccugccagaagggcaacauccgcugcaacaucugcaucuga

SEQ ID NO: 12798 - RNA, 1701 nt, Artificial Sequence; identical to SEQ ID NO: 12137
  derived and/or modified CDS sequence (AUadapt) from InfluenzaA__AIJ10770__HA

SEQ ID NO: 12799 - RNA, 1701 nt, Artificial Sequence; identical to SEQ ID NO: 12137
  derived and/or modified CDS sequence (AUadapt) from InfluenzaA__AIJ10771__HA

SEQ ID NO: 12800 - RNA, 1701 nt, Artificial Sequence; identical to SEQ ID NO: 12137
  derived and/or modified CDS sequence (AUadapt) from InfluenzaA__AIJ10772__HA

SEQ ID NO: 12801 - RNA, 1701 nt, Artificial Sequence; identical to SEQ ID NO: 12137
  derived and/or modified CDS sequence (AUadapt) from InfluenzaA__AIJ10773__HA

SEQ ID NO: 12802 - RNA, 1701 nt, Artificial Sequence
  derived and/or modified CDS sequence (AUadapt) from InfluenzaA__AIJ10774__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccucgggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacucggagggccgggggcaggccgcggaccugaaguccacccagagcgccaucgaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgugcugcucggguucaucaugugggccugccagaagggcaacauccggugcaacaucugcaucuga

SEQ ID NO: 12803 - RNA, 1701 nt, Artificial Sequence
  derived and/or modified CDS sequence (AUadapt) from InfluenzaA__AIJ10776__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcagccucgucgccuccucgggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugucgaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagauguccaagcuguucgagaagaccaagaagcagcugcgcgagaacgcggaggacaugggcaacgggugcuucaagaucuaccacaagugcgacaacgccugcaucggcucgauccgcaacgggacguacgaccacgacguguaccgggacgaggcccucaacaaccgcuuccagaucaagggcgucgagcugaaguccggcuacaaggacuggauccuguggaucagcuucgccaucagcugcuuccuccugugcguggugcugcucggguucaucaugugggccugccagaagggcaacauccggugcaacaucugcaucuga

SEQ ID NO: 12804 - RNA, 1701 nt, Artificial Sequence; identical to SEQ ID NO: 12137
  derived and/or modified CDS sequence (AUadapt) from InfluenzaA__AIJ10777__HA

SEQ ID NO: 12805 - RNA, 1701 nt, Artificial Sequence; identical to SEQ ID NO: 12137
  derived and/or modified CDS sequence (AUadapt) from InfluenzaA__AIJ10778__HA

SEQ ID NO: 12806 - RNA, 1701 nt, Artificial Sequence
  derived and/or modified CDS sequence (AUadapt) from InfluenzaA__AIJ10780__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacuccuuccagaacaagaagugggaccuguucguggagcggagcaaggccuacuccaacugcuaccccuacgacgugccggacuacgcgucgcugcgcucccucgucgccagcuccggcacccuggaguucaacaacgagucguucaacugggccggcgugacgcagaacgggaccuccagcgccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugauggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggacaucgagaaguacguggaggacacgaagaucgaccucugguccuacaacgccgagcugcuggucgcccucgagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcugugcgucgcccuccugggcuucaucaugugggcgugccagaaggggaacauccggugcaacaucugcaucuga

SEQ ID NO: 12807 - RNA, 1701 nt, Artificial Sequence; identical to SEQ ID NO: 12137
  derived and/or modified CDS sequence (AUadapt) from InfluenzaA__AIJ10781__HA

SEQ ID NO: 12808 - RNA, 1701 nt, Artificial Sequence; identical to SEQ ID NO: 12137
  derived and/or modified CDS sequence (AUadapt) from InfluenzaA__AIJ10782__HA

SEQ ID NO: 12809 - RNA, 1701 nt, Artificial Sequence
  derived and/or modified CDS sequence (AUadapt) from InfluenzaA__AIJ10783__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggugggggugacgcagaacggcaccucguccgccugcauccgggggagcaacuccucguucuucucccgccugaacuggcucacccaccugaacuucaaguaccccgcccugaacgucaccaugcccaacaacgagcaguucgacaagcucuacaucuggggcgugcaccaccccgggacggacaaggaccagaucuuccuguacgcgcagagcuccggccggaucaccgugagcaccaagcgcucgcagcaggccgucaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgucaagcaguccacccugaagcucgcgacggggaugcgcaacgugcccgagaagcagacccggggcaucuucggggccaucgccggcuucaucgagaacggcugggaggggaugaaggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 12810 - RNA, 1701 nt, Artificial Sequence; identical to SEQ ID NO: 12809
  derived and/or modified CDS sequence (AUadapt) from InfluenzaA__AIJ10784__HA

SEQ ID NO: 12811 - RNA, 1701 nt, Artificial Sequence
  derived and/or modified CDS sequence (AUadapt) from InfluenzaA__AIJ10785__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcaacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggagcgacgcccccaucggcaagugcaaguccgagugcaucacccccaacgggucgauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugauggacggcugguacggguuccgccaccagaacagcgagggccgggggcaggccgcggaccugaaguccacccagucggccaucgaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcucgauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 12812 - RNA, 1701 nt, Artificial Sequence; identical to SEQ ID NO: 12809
  derived and/or modified CDS sequence (AUadapt) from InfluenzaA__AIJ10786__HA

SEQ ID NO: 12813 - RNA, 1701 nt, Artificial Sequence
  derived and/or modified CDS sequence (AUadapt) from InfluenzaA__AIJ10787__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggugggggugacgcagaacggcaccucguccgccugcauccgggggagcaacuccucguucuucucccgccugaacuggcucacccaccugaacuucaaguaccccgcccugaacgucaccaugcccaacaacgagcaguucgacaagcucuacaucuggggcgugcaccaccccgggacggacaaggaccagaucuuccuguacgcgcagagcuccggccggaucaccgugagcaccaagcgcucgcagcaggccgucaucccgaacaucggcucccggccccgcauccggaacauccccagccgcaucuccaucuacuggaccaucgugaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgucaagcaguccacccugaagcucgcgacggggaugcgcaacgugcccgagaagcagacccggggcaucuucggggccaucgccggcuucaucgagaacggcugggaggggaugaaggacggcugguacggguuccgccaccagaacucggagggccgggggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccggaucaagggcgucgagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 12814 - RNA, 1701 nt, Artificial Sequence; identical to SEQ ID NO: 12811
  derived and/or modified CDS sequence (AUadapt) from InfluenzaA__AIJ10788__HA

SEQ ID NO: 12815 - RNA, 1701 nt, Artificial Sequence; identical to SEQ ID NO: 12811
  derived and/or modified CDS sequence (AUadapt) from InfluenzaA__AIJ10789__HA

SEQ ID NO: 12816 - RNA, 1701 nt, Artificial Sequence; identical to SEQ ID NO: 12809
  derived and/or modified CDS sequence (AUadapt) from InfluenzaA__AIJ10790__HA

SEQ ID NO: 12817 - RNA, 1701 nt, Artificial Sequence; identical to SEQ ID NO: 12137
  derived and/or modified CDS sequence (AUadapt) from InfluenzaA__AIJ10791__HA

SEQ ID NO: 12818 - RNA, 1701 nt, Artificial Sequence
  derived and/or modified CDS sequence (AUadapt) from InfluenzaA__AIJ10792__HA
augaagaccaucaucgcccugucguacauccucugccugguguucgcccagaagcugcccggcgacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggugcugcucggguucaucaugugggccugccagaagggcaacauccggugcaacaucugcaucuga

SEQ ID NO: 12819 - RNA, 1701 nt, Artificial Sequence; identical to SEQ ID NO: 10128
  derived and/or modified CDS sequence (AUadapt) from InfluenzaA__AIJ29347__HA

SEQ ID NO: 12820 - RNA, 1701 nt, Artificial Sequence
  derived and/or modified CDS sequence (AUadapt) from InfluenzaA__AIJ29349__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccagcuccgccugcauccggcgcucgaacuccagcuucuucucccggcugaacuggcugacccaccucaacuucaaguaccccgcccugaacgugacgaugcccaacaacgagcaguucgacaagcuguacaucuggggcguccaccaccccgggaccgacaaggaccagaucuuccucuacgcgcagucguccgggcgcaucaccgugagcaccaagcggagccagcaggccgugaucccgaacaucggcucccgcccccggauccgcaacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 12821 - RNA, 1701 nt, Artificial Sequence
  derived and/or modified CDS sequence (AUadapt) from InfluenzaA__AIJ29351__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagacgaacgagaaguuccaccagaucgagaaggaguucucggagguggagggccgcauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacguguaccgcgacgaggcccucaacaaccgguuccagaucaagggggucgagcucaagucgggcuacaaggacuggauccuguggaucuccuucgccaucagcugccugcugcugugcguggcccuccugggcuucaucaugugggccugccagaaggggaacauccgcugcaacaucugcaucuga

SEQ ID NO: 12822 - RNA, 1701 nt, Artificial Sequence; identical to SEQ ID NO: 9725
  derived and/or modified CDS sequence (AUadapt) from InfluenzaA__AIJ29353__HA

SEQ ID NO: 12823 - RNA, 1701 nt, Artificial Sequence
  derived and/or modified CDS sequence (AUadapt) from InfluenzaA__AIJ29355__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccagcgccugcauccgccgguccaacucguccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaguccucggggcggaucaccgugagcacgaagcgcucccagcaggccgugaucccgaacaucggcucgcggucccgcauccggaacauccccagccgcaucuccaucuacuggaccaucgucaagcccggcgacauccugcucaucaacagcaccgggaaccugaucgcgccccggggcuacuucaagauccgcuccgggaaguccuccaucaugcggucggacgccccgaucggcaagugcaacuccgagugcaucacccccaacggcagcauccccaacgacaagcccuuccagaacgugaaccgcaucacguacggggccugcccgcgguacgugaagcaguccacccugaagcucgccaccggcaugcgcaacguccccgagaagcagacccgggggaucuucggcgccaucgccggguucaucgagaacggcugggagggcaugguggacgggugguacggcuuccgccaccagaacucggaggggcggggccaggccgccgaccugaaguccacgcaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacguguaccgggacgaggcccucaacaaccgcuuccagaucaagggggucgagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 12824 - RNA, 1701 nt, Artificial Sequence; identical to SEQ ID NO: 9319
  derived and/or modified CDS sequence (AUadapt) from InfluenzaA__AIJ29357__HA

SEQ ID NO: 12825 - RNA, 1701 nt, Artificial Sequence
  derived and/or modified CDS sequence (AUadapt) from InfluenzaA__AIJ29359__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggccaucaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 12826 - RNA, 1701 nt, Artificial Sequence
  derived and/or modified CDS sequence (AUadapt) from InfluenzaA__AIJ29361__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgucucccugcgcucgcucguggcguccagcggcacccuggaguucaacaacgaguccuucaacuggacgggggugacccagaacggcaccagcuccgccugcauccggcgcucgaacaacuccuucuucagccggcugaacuggcucacccaccugaacuucaaguaccccgcccugaacgucacgaugcccaacaacgagcaguucgacaagcucuacaucuggggcgugcaccaccccgggaccgacaaggaccagaucuuccuguacgcccaguccucggggcgcaucaccguguccaccaagcggagccagcaggcggucaucccgaacaucggcucgcgcccccggauccgcaacauccccucccggaucagcaucuacuggacgaucgugaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgucaagcagucgacgcugaagcucgccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagagcacccaggccgcgaucgaccagaucaacgggaagcugaaccggcugaucggcaagacgaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12827 - RNA, 1701 nt, Artificial Sequence; identical to SEQ ID NO: 10285
  derived and/or modified CDS sequence (AUadapt) from InfluenzaA__AIL93623__HA

SEQ ID NO: 12828 - RNA, 1701 nt, Artificial Sequence
  derived and/or modified CDS sequence (AUadapt) from InfluenzaA__AIL93634__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcaacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12829 - RNA, 1701 nt, Artificial Sequence
  derived and/or modified CDS sequence (AUadapt) from InfluenzaA__AIL93645__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuuccgguaccccgcgcugaacgugaccaugcccaacaacgagcaguucgacaagcucuacaucuggggcguccaccaccccgggacggacaaggaccagaucuuccuguacgcccagagcuccggccgcaucaccgugagcaccaagcggucgcagcaggccgugaucccgaacaucggcucccgcccccggauccgcaacauccccagccggaucuccaucuacuggaccaucgucaagcccggggacauccugcucaucaacucgacgggcaaccugaucgccccgcgcggguacuucaagauccgguccggcaagagcuccaucaugcgcucggacgcccccaucggcaagugcaaguccgagugcaucacccccaacgggagcauccccaacgacaagccguuccagaacgugaaccggaucaccuacggcgcgugcccccgcuacgugaagcaguccacccugaagcucgccacggggaugcggaacguccccgagaagcagacccgcggcaucuucggggccaucgccggcuucaucgagaacggcugggaggggaugguggacggcugguacggguuccggcaccagaacucggagggccgcgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggcccugcucggguucaucaugugggcgugccagaagggcaacauccgcugcaacaucugcaucuga

SEQ ID NO: 12830 - RNA, 1701 nt, Artificial Sequence; identical to SEQ ID NO: 162
  derived and/or modified CDS sequence (AUadapt) from InfluenzaA__AIL93657__HA

SEQ ID NO: 12831 - RNA, 1701 nt, Artificial Sequence; identical to SEQ ID NO: 162
  derived and/or modified CDS sequence (AUadapt) from InfluenzaA__AIL93669__HA

SEQ ID NO: 12832 - RNA, 1701 nt, Artificial Sequence
  derived and/or modified CDS sequence (AUadapt) from InfluenzaA__AIL93681__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcagcgccggguccggcaucaucaucucggacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 12833 - RNA, 1701 nt, Artificial Sequence; identical to SEQ ID NO: 12829
  derived and/or modified CDS sequence (AUadapt) from InfluenzaA__AIL93692__HA

SEQ ID NO: 12834 - RNA, 1701 nt, Artificial Sequence; identical to SEQ ID NO: 12829
  derived and/or modified CDS sequence (AUadapt) from InfluenzaA__AIL93716__HA

SEQ ID NO: 12835 - RNA, 1701 nt, Artificial Sequence; identical to SEQ ID NO: 162
  derived and/or modified CDS sequence (AUadapt) from InfluenzaA__AIL93728__HA

SEQ ID NO: 12836 - RNA, 1701 nt, Artificial Sequence; identical to SEQ ID NO: 162
  derived and/or modified CDS sequence (AUadapt) from InfluenzaA__AIL93740__HA

SEQ ID NO: 12837 - RNA, 1701 nt, Artificial Sequence
  derived and/or modified CDS sequence (AUadapt) from InfluenzaA__AIL93752__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgaccggccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacugggccggggugacgcagaacggcaccuccucggccugcauccgcggguccaacagcuccuucuucucgcggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccgcaucaccguguccaccaagaagucccagcaggccgugaucccgaacaucggcucgcggccccgcauccggaacauccccagccgcaucucgaucuacuggaccaucgucaagcccggggacauccugcucaucaacuccacgggcaaccugaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 12838 - RNA, 1701 nt, Artificial Sequence
  derived and/or modified CDS sequence (AUadapt) from InfluenzaA__AIL93764__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcucgcucgucgcguccagcggcacgcuggaguucaacaacgaguccuucaacugggccggggugacccagaacggcaccucguccgccugcauccgggggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccggaucaccgugagcaccaagcgcucgcagcaggccgugaucccgaacaucggcucccggccccgcauccggaacauccccagccgcaucuccaucuacuggacgaucgucaagcccggggacauccugcucaucaacucgaccggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgagaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 12839 - RNA, 1701 nt, Artificial Sequence; identical to SEQ ID NO: 162
  derived and/or modified CDS sequence (AUadapt) from InfluenzaA__AIL93776__HA

SEQ ID NO: 12840 - RNA, 1701 nt, Artificial Sequence; identical to SEQ ID NO: 162
  derived and/or modified CDS sequence (AUadapt) from InfluenzaA__AIL93788__HA

SEQ ID NO: 12841 - RNA, 1701 nt, Artificial Sequence; identical to SEQ ID NO: 162
  derived and/or modified CDS sequence (AUadapt) from InfluenzaA__AIL93812__HA

SEQ ID NO: 12842 - RNA, 1701 nt, Artificial Sequence; identical to SEQ ID NO: 162
  derived and/or modified CDS sequence (AUadapt) from InfluenzaA__AIL93824__HA

SEQ ID NO: 12843 - RNA, 1701 nt, Artificial Sequence; identical to SEQ ID NO: 12832
  derived and/or modified CDS sequence (AUadapt) from InfluenzaA__AIL93836__HA

SEQ ID NO: 12844 - RNA, 1701 nt, Artificial Sequence
  derived and/or modified CDS sequence (AUadapt) from InfluenzaA__AIL93847__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcagcgccggguccggcaucaucaucucggacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucugcuucuggaugugcuccaacggcagccugcagugccggaucugcaucuga

SEQ ID NO: 12845 - RNA, 1701 nt, Artificial Sequence; identical to SEQ ID NO: 12829
  derived and/or modified CDS sequence (AUadapt) from InfluenzaA__AIL93858__HA

SEQ ID NO: 12846 - RNA, 1701 nt, Artificial Sequence; identical to SEQ ID NO: 162
  derived and/or modified CDS sequence (AUadapt) from InfluenzaA__AIL93870__HA

SEQ ID NO: 12847 - RNA, 1701 nt, Artificial Sequence
  derived and/or modified CDS sequence (AUadapt) from InfluenzaA__AIL93882__HA
augaagaccaucaucgcccugucguacauccucugccugguguucgcccagaagcccccgggcaacgacaacuccaccgcgacgcugugccucgggcaccacgccguccccaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuacccguacgacgugcccgacuacgcgucccugcgcucgcuggucgccuccagcggcacccucgaguucaacaacgaguccuucaacugggccggggugacgcagaacggcaccucguccgccugcauccgggggagcaacuccucguucuucucccgccugaacuggcugacccaccucaacuucaaguaccccgcgcugaacgugaccaugcccaacaacgagcaguucgacaagcuguacaucuggggcguccaccacccggggacggacaaggaccagaucuuccucuacgcccagagcuccggccggaucaccgugucgaccaagcgcagccagcaggccgugauccccaacaucggcucccggccccgcauccggaacauccccucgcgcaucuccaucuacuggaccaucgucaagccgggggacauccugcugaucaacagcacgggcaaccucaucgcgccccggggguacuucaagauccgcuccggcaagucguccaucaugcggagcgacgcccccaucggcaagugcaaguccgagugcaucacccccaacgggucgaucccgaacgacaagcccuuccagaacgugaaccgcaucaccuacggcgccugcccccgguacgugaagcaguccacccugaagcuggccacggggaugcgcaacguccccgagaagcagacccggggcaucuucggggccaucgccggcuucaucgagaacggcugggaggggaugguggacggcugguacggguuccgccaccagaacagcgagggccgggggcaggccgcggaccucaaguccacccaggccgccaucgaccagaucaacggcaagcugaaccgccugaucggcaagaccaacgagaaguuccaccagaucgagaaggaguucucggagguggaggggcggauccaggaccucgagaaguacgucgaggacacgaagaucgaccugugguccuacaacgccgagcugcucguggcccuggagaaccagcacaccaucgaccugaccgacagcgagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcucaagucgggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 12848 - RNA, 1701 nt, Artificial Sequence; identical to SEQ ID NO: 162
  derived and/or modified CDS sequence (AUadapt) from InfluenzaA__AIL93894__HA

SEQ ID NO: 12849 - RNA, 1701 nt, Artificial Sequence
  derived and/or modified CDS sequence (AUadapt) from InfluenzaA__AIL93906__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagauguuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccacggccgaccagcagucccuguaccagaacgccgacgccuacgucuucgugggcaccucgaaguacuccaagaaguucaagcccgagaucgccauccggccgaaggugcgcgaccaggagggccggaugaacuacuacuggacccugaucgagcccggggacaagaucaccuucgaggcgacgggcaaccucgucgugccccgcuacgccuucgccauggagcggaacgccgggucgggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcgccucgcgacgggccugcggaacgugccgucgauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacucggugaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgucaagcucgagagcacccggaucuaccagauccuggcgaucuacuccaccguggccucgucccuggugcucgucgugagccugggggccaucucguucuggaugugcuccaacggcagccugcagugccgcaucugcaucuga

SEQ ID NO: 12850 - RNA, 1701 nt, Artificial Sequence
  derived and/or modified CDS sequence (AUadapt) from InfluenzaA__AIL93917__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgaccggccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacugggccggggugacgcagaacggcaccuccucggccugcauccgcggguccaacagcuccuucuucucgcggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccgcaucaccguguccaccaagcggucgcagcaggccgugaucccgaacaucggcagccgcccccggauccgcaacauccccucccggaucucgaucuacuggaccaucgucaagcccggggacauccugcucaucaacuccacgggcaaccugaucgccccgcgcggguacuucaagauccggagcggcaaguccucgaucaugcgcuccgacgcccccaucggcaagugcaagagcgagugcaucacccccaacggguccauccccaacgacaagccguuccagaacgugaaccggaucaccuacggcgcgugcccccgcuacgugaagcagucgacccugaagcucgccacggggaugcggaacguccccgagaagcagacccgcggcaucuucggggccaucgccggcuucaucgagaacggcugggaggggaugguggacggcugguacggguuccggcaccagaacuccgagggccgcgggcaggccgcggaccucaagagcacccaggccgccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagaugcgcgagaacgcggaggacaugggcaacgggugcuucaagaucuaccacaagugcgacaacgccugcaucggcagcauccggaacgggacguacgaccacgacguguaccgcgacgaggcccugaacaaccgguuccagaucaagggcgucgagcucaaguccggcuacaaggacuggauccuguggaucagcuucgccaucuccugcuuccugcucugcguggcccugcugggguucaucaugugggcgugccagaagggcaacauccgcugcaacaucugcaucuga

SEQ ID NO: 12851 - RNA, 1701 nt, Artificial Sequence; identical to SEQ ID NO: 10285
  derived and/or modified CDS sequence (AUadapt) from InfluenzaA__AIL93929__HA

SEQ ID NO: 12852 - RNA, 1701 nt, Artificial Sequence
  derived and/or modified CDS sequence (AUadapt) from InfluenzaA__AIL93940__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucucgccccugcaccucgggaagugcaacaucgccggcuggauccuggggaacccggagugcgagucccugagcaccgccuccucgugguccuacaucguggagaccagcuccucggacaacggcacgugcuaccccggcgacuucaucaacuacgaggagcuccgggagcagcuguccagcguguccucguucgagcgcuucgagaucuuccccaagaccuccagcuggcccaaccacgacuccaacaagggggucaccgcggccugcccgcacgccggcgccaagucguucuacaagaaccugaucuggcucgugaagaaggggaacuccuaccccaagcugagccagucguacaucaacgacaagggcaaggaggugcugguccucugggggauccaccaccccuccaccacggcggaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgccaucgcgggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgccuccagccuggugcucguggucucgcugggggcgaucuccuucuggaugugcagcaacggcucccugcagugccggaucugcaucuga

SEQ ID NO: 12853 - RNA, 1701 nt, Artificial Sequence; identical to SEQ ID NO: 162
  derived and/or modified CDS sequence (AUadapt) from InfluenzaA__AIL93951__HA

SEQ ID NO: 12854 - RNA, 1701 nt, Artificial Sequence; identical to SEQ ID NO: 162
  derived and/or modified CDS sequence (AUadapt) from InfluenzaA__AIL93963__HA

SEQ ID NO: 12855 - RNA, 1701 nt, Artificial Sequence; identical to SEQ ID NO: 10103
  derived and/or modified CDS sequence (AUadapt) from InfluenzaA__AIL93975__HA

SEQ ID NO: 12856 - RNA, 1701 nt, Artificial Sequence; identical to SEQ ID NO: 12832
  derived and/or modified CDS sequence (AUadapt) from InfluenzaA__AIL93987__HA

SEQ ID NO: 12857 - RNA, 1701 nt, Artificial Sequence; identical to SEQ ID NO: 162
  derived and/or modified CDS sequence (AUadapt) from InfluenzaA__AIL93998__HA

SEQ ID NO: 12858 - RNA, 1701 nt, Artificial Sequence; identical to SEQ ID NO: 12829
  derived and/or modified CDS sequence (AUadapt) from InfluenzaA__AIL94010__HA

SEQ ID NO: 12859 - RNA, 1701 nt, Artificial Sequence; identical to SEQ ID NO: 12829
  derived and/or modified CDS sequence (AUadapt) from InfluenzaA__AIL94022__HA

SEQ ID NO: 12860 - RNA, 1701 nt, Artificial Sequence
  derived and/or modified CDS sequence (AUadapt) from InfluenzaA__AIL94046__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgaccggccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacugggccggggugacgcagaacggcaccuccucggccugcauccgcggguccaacagcuccuucuucucgcggcugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccgcaucaccguguccaccaagcggucgcagcaggccgugaucccgaacaucggcagccgcccccggauccgcaacauccccucccggaucucgaucuacuggaccaucgucaagcccggggacauccugcucaucaacuccacgggcaaccugaucgccccgcgcggguacuucaagauccggagcggcaaguccucgaucaugcgcuccgacgcccccaucggcaagugcaagagcgagugcaucacccccaacggguccauccccaacgacaagccguuccagaacgugaaccggaucaccuacggcgcgugcccccgcuacgugaagcagucgacccugaagcucgccacggggaugcggaacguccccgagaagcagacccgcggcaucuucggggccaucgccggcuucaucgagaacggcugggaggggaugguggacggcugguacggguuccggcaccagaacuccgagggccgcgggcaggccgcggaccucaagagcacccaggccgccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccggaacgggacguacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaugugggcgugccagaagggcaacauccgcugcaacaucugcaucuga

SEQ ID NO: 12861 - RNA, 1701 nt, Artificial Sequence
  derived and/or modified CDS sequence (AUadapt) from InfluenzaA__AIL94058__HA
augaaggccauccuggugguccuccuguacaccuucgcccccgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgccccgcugcaccucgggaagugcaacaucgccggcuggauccuggggaaccccgagugcgagucgcuguccaccgcgagcuccuggucguacaucguggagaccuccagcuccgacaacgggaccugcuaccccggcgacuucaucaacuacgaggagcuccgggagcagcugucguccgugagcuccuucgagcgcuucgagaucuuccccaagacgucguccuggccgaaccacgacagcaacaagggcgucaccgccgccugcccccacgccggcgcgaaguccuucuacaagaaccugaucuggcucgugaagaaggggaacucguaccccaagcugucccagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucacgaucgagcgcagcgccggguccggcaucaucaucucggacaccccggugcacgacugcaacacgaccugccagacccccgagggcgccaucaacaccucccugcccuuccagaacauccaccccaucaccaucgggaagugcccgaaguacgucaagagcaccaagcugcggcucgccacgggccugcgcaacgugcccuccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 12862 - RNA, 1701 nt, Artificial Sequence; identical to SEQ ID NO: 12832
  derived and/or modified CDS sequence (AUadapt) from InfluenzaA__AIL94069__HA

SEQ ID NO: 12863 - RNA, 1701 nt, Artificial Sequence; identical to SEQ ID NO: 10285
  derived and/or modified CDS sequence (AUadapt) from InfluenzaA__AIL94080__HA

SEQ ID NO: 12864 - RNA, 1701 nt, Artificial Sequence; identical to SEQ ID NO: 12829
  derived and/or modified CDS sequence (AUadapt) from InfluenzaA__AIL94235__HA

SEQ ID NO: 12865 - RNA, 1701 nt, Artificial Sequence; identical to SEQ ID NO: 10285
  derived and/or modified CDS sequence (AUadapt) from InfluenzaA__AIL94247__HA

SEQ ID NO: 12866 - RNA, 1701 nt, Artificial Sequence
  derived and/or modified CDS sequence (AUadapt) from InfluenzaA__AIL94258__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccgcaucgaggugaccaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgccucccugcgcucgcucgucgcguccagcggcacgcuggaguucaacaacgaguccuucaacugggccggggugacccagaacggcaccucguccgccugcauccgggggagcaacuccucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccggccggaucaccgugagcaccaagcgcucgcagcaggccgugaucccgaacaucggcucccggccccgcauccggaacauccccagccgcaucuccaucuacuggacgaucgucaagcccggggacauccugcucaucaacucgaccggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacgcugaagcucgcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccugaaguccacccaggcggccaucgaccagaucaacggcaagcugaaccgccucaucggcaagacgaacgagaaguuccaccagaucgagaaggaguucagcgagguggaggggcggauccaggaccuggagaaguacgucgaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 12867 - RNA, 1701 nt, Artificial Sequence
  derived and/or modified CDS sequence (AUadapt) from InfluenzaA__AIL94270__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaacuccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 12868 - RNA, 1701 nt, Artificial Sequence; identical to SEQ ID NO: 162
  derived and/or modified CDS sequence (AUadapt) from InfluenzaA__AIL94282__HA

SEQ ID NO: 12869 - RNA, 1701 nt, Artificial Sequence; identical to SEQ ID NO: 162
  derived and/or modified CDS sequence (AUadapt) from InfluenzaA__AIL94294__HA

SEQ ID NO: 12870 - RNA, 1701 nt, Artificial Sequence
  derived and/or modified CDS sequence (AUadapt) from InfluenzaA__AIL94306__HA
augaagaccaucaccgcccugucguacauccucugccuggccuucgcgcagaagcccccgggcaacgacaacuccacggccacccugugccucgggcaccacgccgugcccaacggcaccaucgucaagaccaucacgaacgaccgcaucgaggugaccaacgccaccgagcuggugcagaacucguccaucggggagaucugcgacagcccccaccagauccuggacggcgagaacugcacccucaucgacgcccugcugggggacccccagugcgacggcuuccagaacaagaagugggaccucuucgucgagcgguccaaggcguacucgaacugcuacccguacgacgugcccgacuacgccucccugcgcagccugguggccuccucgggcacgcucgaguucaacaacgaguccuucaacugggccggggucacccagaacggcaccucguccgcgugcauccgggggagcaacuccucguucuucucccgccugaacuggcugacccaccucaacuucaaguaccccgcccugaacgugacgaugcccaacaacgagcaguucgacaagcuguacaucuggggcgugcaccacccggggaccgacaaggaccagaucuuccucuacgcccagagcuccggccggaucaccgucucgaccaagcgcucgcagcaggccgugauccccaacaucggcucccggccccgcauccggaacauccccagccgcaucuccaucuacuggacgaucgugaagccgggggacauccugcugaucaacucgaccggcaaccucaucgcgccccggggguacuucaagauccgcuccggcaagagcuccaucaugcggucggacgcccccaucggcaagugcaaguccgagugcaucacccccaacgggucgaucccgaacgacaagcccuuccagaacgucaaccgcaucaccuacggcgccugcccccgguacgugaagcaguccacgcugaagcuggccaccgggaugcgcaacgugcccgagaagcagacccggggcaucuucggggccaucgccggcuucaucgagaacggcugggaggggauggucgacggcugguacggguuccgccaccagaacagcgagggccgggggcaggcggccgaccucaaguccacccaggccgccaucgaccagaucaacggcaagcugaaccgccugaucggcaagacgaacgagaaguuccaccagaucgagaaggaguucucggagguggaggggcggauccaggaccucgagaaguacguggaggacaccaagaucgaccugugguccuacaacgccgagcugcucgucgcgcuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcucaagucgggcuacaaggacuggauccuguggaucuccuucgccaucagcugcuuccugcucugcgucgcgcugcugggguucaucaugugggccugccagaagggcaacauccggugcaacaucugcaucuga

SEQ ID NO: 12871 - RNA, 1701 nt, Artificial Sequence
  derived and/or modified CDS sequence (AUadapt) from InfluenzaA__AIL94318__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccagcuccgccugcauccggcgcucgaacuccagcuucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagucguccgggcgcaucaccgugagcaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucaccuacggggccugcccccgcuacgugaagcaguccacgcugaagcucgcgaccggcaugcggaacguccccgagaagcagacccgcgggaucuucggcgccaucgccggguucaucgagaacggcugggagggcaugguggacgggugguacggcuuccggcaccugaacucggaggggcgcggccaggccgccgaccugaaguccacccaggcggccaucgaccagaucaacgggaagcucaaccggcugaucggcaagacgaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcugugcguggcccuccugggcuucaucaugugggccugccagaaggggaacauccgcugcaacaucugcaucuga

SEQ ID NO: 12872 - RNA, 1701 nt, Artificial Sequence; identical to SEQ ID NO: 10103
  derived and/or modified CDS sequence (AUadapt) from InfluenzaA__AIL94330__HA

SEQ ID NO: 12873 - RNA, 1701 nt, Artificial Sequence; identical to SEQ ID NO: 10285
  derived and/or modified CDS sequence (AUadapt) from InfluenzaA__AIL94354__HA

SEQ ID NO: 12874 - RNA, 1701 nt, Artificial Sequence; identical to SEQ ID NO: 162
  derived and/or modified CDS sequence (AUadapt) from InfluenzaA__AIL94365__HA

SEQ ID NO: 12875 - RNA, 1701 nt, Artificial Sequence
  derived and/or modified CDS sequence (AUadapt) from InfluenzaA__AIL94377__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccacugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 12876 - RNA, 1701 nt, Artificial Sequence
  derived and/or modified CDS sequence (AUadapt) from InfluenzaA__AIL94389__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcugauccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 12877 - RNA, 1701 nt, Artificial Sequence; identical to SEQ ID NO: 162
  derived and/or modified CDS sequence (AUadapt) from InfluenzaA__AIL94411__HA

SEQ ID NO: 12878 - RNA, 1701 nt, Artificial Sequence; identical to SEQ ID NO: 162
  derived and/or modified CDS sequence (AUadapt) from InfluenzaA__AIL94423__HA

SEQ ID NO: 12879 - RNA, 1701 nt, Artificial Sequence; identical to SEQ ID NO: 12832
  derived and/or modified CDS sequence (AUadapt) from InfluenzaA__AIL94435__HA

SEQ ID NO: 12880 - RNA, 1701 nt, Artificial Sequence; identical to SEQ ID NO: 162
  derived and/or modified CDS sequence (AUadapt) from InfluenzaA__AIL94446__HA

SEQ ID NO: 12881 - RNA, 1701 nt, Artificial Sequence; identical to SEQ ID NO: 162
  derived and/or modified CDS sequence (AUadapt) from InfluenzaA__AIL94458__HA

SEQ ID NO: 12882 - RNA, 1701 nt, Artificial Sequence
  derived and/or modified CDS sequence (AUadapt) from InfluenzaA__AIL94470__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgcccacgacugcaacaccacgugccagaccccggagggcgccaucaacaccucgcugcccuuccagaacauccaccccaucaccaucgggaagugccccaaguacgugaaguccacgaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacaagaucacgaacaaggugaacucggugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggagaagaucgacggcgugaagcucgagucgacccgcaucuaccagauccuggcgaucuacuccaccguggccucgucccugguccucguggugagccugggggccaucucguucuggaugugcuccaacggcagccugcagugccggaucugcaucuga

SEQ ID NO: 12883 - RNA, 1701 nt, Artificial Sequence
  derived and/or modified CDS sequence (AUadapt) from InfluenzaA__AIL94481__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggaucaucuggaucuccuucgccaucagcugcuuccugcugugcguggcccugcugggguucaucaugugggcgugccagaagggcaacauccggugcaacaucugcaucuga

SEQ ID NO: 12884 - RNA, 1701 nt, Artificial Sequence
  derived and/or modified CDS sequence (AUadapt) from InfluenzaA__AIL94493__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagaagaacgccgggagcggcaucaucaucuccgacacccccgugcacgacugcaacaccacgugccagaccccggagggcgccaucaacaccucguuccccuuccagaacauccaccccaucaccaucgggaagugccccaaguacgugaaguccacgaagcugcgccuggccaccggccuccggaacgucccgagcauccagucccgcgggcuguucggcgcgaucgccggguucaucgagggcggcuggaccgggaugguggacggcugguacggguaccaccaccagaacgagcagggcucgggguacgccgccgaccugaaguccacccagaacgccaucgacaagaucacgaacaaggugaacagcgucaucgagaagaugaacacccaguucaccgcggugggcaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgugaagaaccuguacgagaagguccggaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcuggagagcacccggaucuaccagauccucgccaucuacuccaccgucgcgucgucccuggugcugguggucagccucggggccaucucguucuggaugugcuccaacggcagccugcagugccgcaucugcaucuga

SEQ ID NO: 12885 - RNA, 1701 nt, Artificial Sequence; identical to SEQ ID NO: 12832
  derived and/or modified CDS sequence (AUadapt) from InfluenzaA__AIL94504__HA

SEQ ID NO: 12886 - RNA, 1701 nt, Artificial Sequence; identical to SEQ ID NO: 162
  derived and/or modified CDS sequence (AUadapt) from InfluenzaA__AIL94515__HA

SEQ ID NO: 12887 - RNA, 1701 nt, Artificial Sequence; identical to SEQ ID NO: 162
  derived and/or modified CDS sequence (AUadapt) from InfluenzaA__AIL94527__HA

SEQ ID NO: 12888 - RNA, 1701 nt, Artificial Sequence
  derived and/or modified CDS sequence (AUadapt) from InfluenzaA__AIL94539__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgcccacgacugcaacaccacgugccagaccccggagggcgccaucaacaccucgcugcccuuccagaacauccaccccaucaccaucgggaagugccccaaguacgugaaguccacgaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcucgggguacgccgccgaccucaaguccacccagaacgcgaucgacaagaucacgaacaaggugaacucggugaucgagaagaugaacacccaguucaccgccgucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggaggucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12889 - RNA, 1701 nt, Artificial Sequence; identical to SEQ ID NO: 12832
  derived and/or modified CDS sequence (AUadapt) from InfluenzaA__AIL94550__HA

SEQ ID NO: 12890 - RNA, 1701 nt, Artificial Sequence
  derived and/or modified CDS sequence (AUadapt) from InfluenzaA__AIL94561__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagcggggcaacauccgcugcaacaucugcaucuga

SEQ ID NO: 12891 - RNA, 1701 nt, Artificial Sequence
  derived and/or modified CDS sequence (AUadapt) from InfluenzaA__AIL94573__HA
augaaggccauccuggugguccuccuguacaccuucgccaccgcgaacgccgacacgcugugcaucggcuaccacgccaacaacucgaccgacaccguggacaccgugcucgagaagaacgucaucgugacgcacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacgggaccugcuaccccggcgacuucaucaacuacgaggagcuccgggagcagcugucguccgugagcuccuucgagcgcuucgagaucuuccccaagacgucguccuggcccaaccacgacagcaacaagggcgucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccaccgccgaccagcagucccuguaccagaacgccgacgccuacguguucgugggcacgucgcgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucacgauggagcgcaacgccgggagcggcaucaucaucuccgacacccccgugcacgacugcaacacgaccugccagaccccggagggcgccaucaacaccucgcugcccuuccagaacauccaccccaucaccaucgggaagugccccaaguacgugaaguccaccaagcugcggcucgccacgggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcgucuaccagauccuggccaucuacuccaccguggcgucgucccuggugcucgucgugagccugggggccaucucguucuggaugugcuccaacggcagccugcagugccggaucugcaucuga

SEQ ID NO: 12892 - RNA, 1701 nt, Artificial Sequence
  derived and/or modified CDS sequence (AUadapt) from InfluenzaA__AIL94584__HA
augaaggccauccuggugguccuccuguacaccuucgccaccgcgaacgccgacacgcugugcaucggcuaccacgccaacaacucgaccgacaccguggacaccgugcucgagaagaacaucacggucacccacuccgugaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcugucccagucguacaucaacgacaagggcaaggaggugcuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggcggugccccaaguacgugaaguccacgaagcugcgccucgccaccggccugcggaacgugccgucgauccagucccgcgggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcggaucgagaaccugaacaagaagguggacgacggcuuccucgacaucuggaccuacaacgccgagcugcugguccuccuggagaacgagcgcacgcuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgagaagaucgacggcgugaagcucgagagcacccggaucuaccagauccuggccaucuacuccaccguggcgucgucccugguccucguggugagccugggggccaucucguucuggaugugcuccaacggcagccugcagugccgcaucugcaucuga

SEQ ID NO: 12893 - RNA, 1701 nt, Artificial Sequence; identical to SEQ ID NO: 12300
  derived and/or modified CDS sequence (AUadapt) from InfluenzaA__AIL94595__HA

SEQ ID NO: 12894 - RNA, 1701 nt, Artificial Sequence; identical to SEQ ID NO: 162
  derived and/or modified CDS sequence (AUadapt) from InfluenzaA__AIL94606__HA

SEQ ID NO: 12895 - RNA, 1701 nt, Artificial Sequence; identical to SEQ ID NO: 10285
  derived and/or modified CDS sequence (AUadapt) from InfluenzaA__AIL94618__HA

SEQ ID NO: 12896 - RNA, 1701 nt, Artificial Sequence; identical to SEQ ID NO: 12832
  derived and/or modified CDS sequence (AUadapt) from InfluenzaA__AIL94629__HA

SEQ ID NO: 12897 - RNA, 1701 nt, Artificial Sequence; identical to SEQ ID NO: 162
  derived and/or modified CDS sequence (AUadapt) from InfluenzaA__AIL94640__HA

SEQ ID NO: 12898 - RNA, 1701 nt, Artificial Sequence
  derived and/or modified CDS sequence (AUadapt) from InfluenzaA__AIL94652__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagauguuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccacggccgaccagcagucccuguaccagaacgccgacgccuacgucuucgugggcaccucgaaguacuccaagaaguucaagcccgagaucgccauccggccgaaggugcgcgaccaggagggccggaugaacuacuacuggacccugaucgagcccggggacaagaucaccuucgaggcgacgggcaaccucgucgugccccgcuacgccuucgccauggagcggaacgccgggucgggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcgccucgcgacgggccugcggaacgugccgucgauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggucaacucggugaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagucggugaagaacgggaccuacgacuaccccaaguacuccgaggaggccaagcuggaccgcgagaagaucgacggcgucaagcucgagagcacccggaucuaccagauccuggcgaucuacuccaccguggccucgucccuggugcucgucgugagccugggggccaucucguucuggaugugcuccaacggcagccugcagugccgcaucugcaucuga

SEQ ID NO: 12899 - RNA, 1701 nt, Artificial Sequence; identical to SEQ ID NO: 10285
  derived and/or modified CDS sequence (AUadapt) from InfluenzaA__AIL94663__HA

SEQ ID NO: 12900 - RNA, 1701 nt, Artificial Sequence; identical to SEQ ID NO: 10285
  derived and/or modified CDS sequence (AUadapt) from InfluenzaA__AIL94674__HA

SEQ ID NO: 12901 - RNA, 1701 nt, Artificial Sequence; identical to SEQ ID NO: 162
  derived and/or modified CDS sequence (AUadapt) from InfluenzaA__AIL94697__HA

SEQ ID NO: 12902 - RNA, 1701 nt, Artificial Sequence; identical to SEQ ID NO: 10285
  derived and/or modified CDS sequence (AUadapt) from InfluenzaA__AIL94709__HA

SEQ ID NO: 12903 - RNA, 1701 nt, Artificial Sequence; identical to SEQ ID NO: 10285
  derived and/or modified CDS sequence (AUadapt) from InfluenzaA__AIL94720__HA

SEQ ID NO: 12904 - RNA, 1701 nt, Artificial Sequence; identical to SEQ ID NO: 162
  derived and/or modified CDS sequence (AUadapt) from InfluenzaA__AIL94731__HA

SEQ ID NO: 12905 - RNA, 1701 nt, Artificial Sequence; identical to SEQ ID NO: 12832
  derived and/or modified CDS sequence (AUadapt) from InfluenzaA__AIL94743__HA

SEQ ID NO: 12906 - RNA, 1701 nt, Artificial Sequence
  derived and/or modified CDS sequence (AUadapt) from InfluenzaA__AIL94754__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcugauccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagagcgccaagaacgggaccuacgacuaccccaaguacuccgaggaggccaagcugaaccgggagaagaucgacggcgucaagcucgagucgacccgcaucuaccagauccuggcgaucuacuccaccguggccucgucccuggugcucgucgugagccugggggccaucucguucuggaugugcuccaacggcagccugcagugccggaucugcaucuga

SEQ ID NO: 12907 - RNA, 1701 nt, Artificial Sequence; identical to SEQ ID NO: 12860
  derived and/or modified CDS sequence (AUadapt) from InfluenzaA__AIL94765__HA

SEQ ID NO: 12908 - RNA, 1701 nt, Artificial Sequence; identical to SEQ ID NO: 162
  derived and/or modified CDS sequence (AUadapt) from InfluenzaA__AIL94777__HA

SEQ ID NO: 12909 - RNA, 1701 nt, Artificial Sequence; identical to SEQ ID NO: 12147
  derived and/or modified CDS sequence (AUadapt) from InfluenzaA__AIL94789__HA

SEQ ID NO: 12910 - RNA, 1701 nt, Artificial Sequence; identical to SEQ ID NO: 10285
  derived and/or modified CDS sequence (AUadapt) from InfluenzaA__AIL94800__HA

SEQ ID NO: 12911 - RNA, 1701 nt, Artificial Sequence
  derived and/or modified CDS sequence (AUadapt) from InfluenzaA__AIL94811__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugucgaccaagcggagccagcaggccgugaucccgaacaucggcucccgcccccggauccgcaacauccccucgcggaucuccaucuacuggacgaucgucaagcccggcgacauccugcucaucaacagcaccgggaaccugaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcagaacacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 12912 - RNA, 1701 nt, Artificial Sequence; identical to SEQ ID NO: 10103
  derived and/or modified CDS sequence (AUadapt) from InfluenzaA__AIL94823__HA

SEQ ID NO: 12913 - RNA, 1701 nt, Artificial Sequence
  derived and/or modified CDS sequence (AUadapt) from InfluenzaA__AIL94835__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacuacagcaucggggagaucugcgacucgccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccagcuccggcacccuggaguucaacaacgagagcuucaacugggccggggugacgcagaacggcaccuccucggccugcauccggggguccaacagcuccuucuucucgcgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccaguccagcggccggaucaccguguccaccaagcgcucgcagcaggccgugaucccgaacaucggcagccggccccgcauccggaacauccccucccgcaucagcaucuacuggaccaucgucaagcccggggacauccugcucaucaacuccacgggcaaccugaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcagagcacccugaagcucgccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccugaaguccacccaggccgccaucgaccagaucaacggcaagcugaaccgccucaucggcaagaccaacgagaaguuccaccagaucgagaaggaguucuccgagguggaggggcggauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgcggaggacaugggcaacgggugcuucaagaucuaccacaagugcgacaacgccugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggcgugccagaagggcaacauccggugcaacaucugcaucuga

SEQ ID NO: 12914 - RNA, 1701 nt, Artificial Sequence
  derived and/or modified CDS sequence (AUadapt) from InfluenzaA__AIL94847__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaaguucaaguaccccgcccugaacgugaccaugcccaacgacgagaaguucgacaagcucuacaucuggggcguccaccaccccgggaccgacaacgaccagaucuuccuguacgcgcaggccagcgggcggaucaccguguccacgaagcgcucgcagcagaccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 12915 - RNA, 1701 nt, Artificial Sequence; identical to SEQ ID NO: 5778
  derived and/or modified CDS sequence (AUadapt) from InfluenzaA__AIL94859__HA

SEQ ID NO: 12916 - RNA, 1701 nt, Artificial Sequence
  derived and/or modified CDS sequence (AUadapt) from InfluenzaA__AIL94871__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacaacucguucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcucgcagcaggccgugaucccgaacaucggcagccggccccgcguccggaacauccccucccgcaucucgaucuacuggaccaucgugaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucacguacggggcgugcccccgguacgucaagcagucgacccugaagcucgccaccggcaugcgcaacgugcccgagaagcagacccgggggaucuucggcgccaucgccggguucaucgagaacggcugggagggcaugguggacgggugguacggcuuccgccaccagaacuccgaggggcggggccaggccgcggaccugaaguccacgcaggccgccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgcggaggacauggggaacggcugcuucaccaucuaccacaagugcgacaacgccugcaucgggucgauccgcaacggcaccuacgaccacaacgucuaccgggacgaggcccucaacaaccgcuuccagaucaaggggaucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 12917 - RNA, 1701 nt, Artificial Sequence; identical to SEQ ID NO: 12325
  derived and/or modified CDS sequence (AUadapt) from InfluenzaA__AIL94883__HA

SEQ ID NO: 12918 - RNA, 1701 nt, Artificial Sequence; identical to SEQ ID NO: 12310
  derived and/or modified CDS sequence (AUadapt) from InfluenzaA__AIL94894__HA

SEQ ID NO: 12919 - RNA, 1701 nt, Artificial Sequence; identical to SEQ ID NO: 10103
  derived and/or modified CDS sequence (AUadapt) from InfluenzaA__AIL94906__HA

SEQ ID NO: 12920 - RNA, 1701 nt, Artificial Sequence; identical to SEQ ID NO: 162
  derived and/or modified CDS sequence (AUadapt) from InfluenzaA__AIL94918__HA

SEQ ID NO: 12921 - RNA, 1701 nt, Artificial Sequence; identical to SEQ ID NO: 162
  derived and/or modified CDS sequence (AUadapt) from InfluenzaA__AIL94930__HA

SEQ ID NO: 12922 - RNA, 1701 nt, Artificial Sequence; identical to SEQ ID NO: 162
  derived and/or modified CDS sequence (AUadapt) from InfluenzaA__AIL94942__HA

SEQ ID NO: 12923 - RNA, 1701 nt, Artificial Sequence; identical to SEQ ID NO: 10285
  derived and/or modified CDS sequence (AUadapt) from InfluenzaA__AIL94954__HA

SEQ ID NO: 12924 - RNA, 1701 nt, Artificial Sequence; identical to SEQ ID NO: 10103
  derived and/or modified CDS sequence (AUadapt) from InfluenzaA__AIL94965__HA

SEQ ID NO: 12925 - RNA, 1701 nt, Artificial Sequence
  derived and/or modified CDS sequence (AUadapt) from InfluenzaA__AIM55837__HA
augaaggccauccuggugguccuccuguacaccuucgccaccgcgacggccgacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgacgaccgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugagccucgccaccggccugcggaacgucccguccauccagucgcgcgggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacucgaacgugaagaaccucuacgagaagguccggaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgagaagaucgacggcgugaagcucgaguccacccggaucuaccagauccuggccaucuacucgaccgucgcguccagccuggugcucguggucucgcugggggccaucuccuucuggaugugcagcaacggcucccugcagugccgcaucugcaucuga

SEQ ID NO: 12926 - RNA, 1701 nt, Artificial Sequence
  derived and/or modified CDS sequence (AUadapt) from InfluenzaA__AIM55848__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacaucccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacacggagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggccucgucccugguccucguggugagccugggggcgaucucguucuggaugugcuccaacggcagccugcagugccggaucugcaucuga

SEQ ID NO: 12927 - RNA, 1701 nt, Artificial Sequence; identical to SEQ ID NO: 10285
  derived and/or modified CDS sequence (AUadapt) from InfluenzaA__AIM55859__HA

SEQ ID NO: 12928 - RNA, 1701 nt, Artificial Sequence; identical to SEQ ID NO: 10285
  derived and/or modified CDS sequence (AUadapt) from InfluenzaA__AIM55870__HA

SEQ ID NO: 12929 - RNA, 1701 nt, Artificial Sequence; identical to SEQ ID NO: 10285
  derived and/or modified CDS sequence (AUadapt) from InfluenzaA__AIM55881__HA

SEQ ID NO: 12930 - RNA, 1701 nt, Artificial Sequence; identical to SEQ ID NO: 12147
  derived and/or modified CDS sequence (AUadapt) from InfluenzaA__AIM55893__HA

SEQ ID NO: 12931 - RNA, 1701 nt, Artificial Sequence; identical to SEQ ID NO: 11266
  derived and/or modified CDS sequence (AUadapt) from InfluenzaA__AIM55904__HA

SEQ ID NO: 12932 - RNA, 1701 nt, Artificial Sequence; identical to SEQ ID NO: 10285
  derived and/or modified CDS sequence (AUadapt) from InfluenzaA__AIM55915__HA

SEQ ID NO: 12933 - RNA, 1710 nt, Artificial Sequence
  derived and/or modified CDS sequence (AUadapt) from InfluenzaA__AIM55926__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagacguccucguccgacaacgggaccugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggagcggcaucaucaucuccgacacccccgugcacgacugcaacacgaccugccagaccccggagggcgccaucaacaccucgcugacgucccugcccuuccagaacauccaccccaucaccaucgggaagugccccaaguacgucaagagcaccaagcuccggcuggccaccggccugcgcaacgugccguccauccagucgcggggccucuucggcgccaucgcgggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgcggagcugcucgugcugcuggagaacgagcggacccucgacuaccacgacucgaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacucgaccgucgccuccagccucgugcugguggucucgcugggggcgaucuccuucuggaugugcagcaacggcucccuccagugccggaucugcaucuga

SEQ ID NO: 12934 - RNA, 1701 nt, Artificial Sequence; identical to SEQ ID NO: 10285
  derived and/or modified CDS sequence (AUadapt) from InfluenzaA__AIM55937__HA

SEQ ID NO: 12935 - RNA, 1701 nt, Artificial Sequence; identical to SEQ ID NO: 11266
  derived and/or modified CDS sequence (AUadapt) from InfluenzaA__AIM55948__HA

SEQ ID NO: 12936 - RNA, 1701 nt, Artificial Sequence; identical to SEQ ID NO: 11248
  derived and/or modified CDS sequence (AUadapt) from InfluenzaA__AIM55962__HA

SEQ ID NO: 12937 - RNA, 1701 nt, Artificial Sequence; identical to SEQ ID NO: 11266
  derived and/or modified CDS sequence (AUadapt) from InfluenzaA__AIM55984__HA

SEQ ID NO: 12938 - RNA, 1701 nt, Artificial Sequence; identical to SEQ ID NO: 12147
  derived and/or modified CDS sequence (AUadapt) from InfluenzaA__AIM55995__HA

SEQ ID NO: 12939 - RNA, 1701 nt, Artificial Sequence
  derived and/or modified CDS sequence (AUadapt) from InfluenzaA__AIM56017__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggcacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12940 - RNA, 1701 nt, Artificial Sequence; identical to SEQ ID NO: 12939
  derived and/or modified CDS sequence (AUadapt) from InfluenzaA__AIM56028__HA

SEQ ID NO: 12941 - RNA, 1701 nt, Artificial Sequence
  derived and/or modified CDS sequence (AUadapt) from InfluenzaA__AIM56039__HA
augaaggccauccuggugguccuccuguaccccuucgccaccgcgaacgccgacacccugugcaucggcuaccacgccaacaacucgacggacaccguggacaccgugcucgagaagaacgucaccgugacgcacuccgugaaccugcuggaggacaagcacaacgggaagcucugcaagcugcgcggcgucgccccgcugcaccucgggaagugcaacaucgccggcuggauccuggggaaccccgagugcgagucgcuguccaccgcgagcuccuggucguacaucguggaggccuccagcuccgacaacgggaccugcuaccccggcgacuucaucaacuacgaggagcuccgggagcagcugucguccgugucguccuucgagcgcuucgagaucuuccccaagaccagcuccuggccgaaccacgacucgaacaagggcgucacggccgccugcccccacgcgggcgccaaguccuucuacaagaaccugaucuggcucgugaagaaggggaacagcuaccccaagcugucccagucguacaucaacgacaagggcaaggaggugcugguccucugggggauccaccaccccagcaccaccgccgaccagcagucccuguaccagaacgccgacgccuacguguucgugggcaccucgcgguacuccaagaaguucaagccggagaucgcgauccgccccaagguccgggaccaggagggccgcaugaacuacuacuggacgcugguggagcccggggacaagaucaccuucgaggccaccggcaaccucguggucccccgguacgccuucaccauggagcgcaacgccgggucgggcaucaucaucuccgacacgccggugcacgacugcaacacgaccugccagacccccgagggcgccaucaacaccagccugcccuuccagaacauccaccccaucaccaucgggaagugcccgaaguacgugaaguccaccaagcugcggcucgcgaccggccugcgcaacguccccucgauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacaagaucaccaacaaggugaacucggucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 12942 - RNA, 1701 nt, Artificial Sequence
  derived and/or modified CDS sequence (AUadapt) from InfluenzaA__AIM56050__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccggggcaagaucgacggggugaagcucgagagcacccgcaucuaccagauccuggccaucuacuccaccgucgccucgucccuggugcucguggucagccugggcgcgaucucguucuggaugugcuccaacggcagccugcagugccggaucugcaucuga

SEQ ID NO: 12943 - RNA, 1701 nt, Artificial Sequence; identical to SEQ ID NO: 10285
  derived and/or modified CDS sequence (AUadapt) from InfluenzaA__AIM56061__HA

SEQ ID NO: 12944 - RNA, 1701 nt, Artificial Sequence; identical to SEQ ID NO: 10285
  derived and/or modified CDS sequence (AUadapt) from InfluenzaA__AIM56072__HA

SEQ ID NO: 12945 - RNA, 1701 nt, Artificial Sequence; identical to SEQ ID NO: 12138
  derived and/or modified CDS sequence (AUadapt) from InfluenzaA__AIM56083__HA

SEQ ID NO: 12946 - RNA, 1701 nt, Artificial Sequence; identical to SEQ ID NO: 10285
  derived and/or modified CDS sequence (AUadapt) from InfluenzaA__AIM56105__HA

SEQ ID NO: 12947 - RNA, 1701 nt, Artificial Sequence; identical to SEQ ID NO: 10285
  derived and/or modified CDS sequence (AUadapt) from InfluenzaA__AIM56116__HA

SEQ ID NO: 12948 - RNA, 1701 nt, Artificial Sequence
  derived and/or modified CDS sequence (AUadapt) from InfluenzaA__AIM56127__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaaggccagcuccuggcccaaccacgacucgaacaagggggucaccgccgccugcccgcacgcgggcgccaaguccuucuacaagaaccugaucuggcucgugaagaaggggaacagcuaccccaagcugucccagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucacgauggagcgcaacgccgggucgggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacaucccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggcgaucuacuccaccguggccucgucccugguccucguggugagccugggggccaucucguucuggaugugcuccaacggcagccugcagugccggaucugcaucuga

SEQ ID NO: 12949 - RNA, 1701 nt, Artificial Sequence; identical to SEQ ID NO: 10285
  derived and/or modified CDS sequence (AUadapt) from InfluenzaA__AIM56138__HA

SEQ ID NO: 12950 - RNA, 1701 nt, Artificial Sequence; identical to SEQ ID NO: 10285
  derived and/or modified CDS sequence (AUadapt) from InfluenzaA__AIM56149__HA

SEQ ID NO: 12951 - RNA, 1701 nt, Artificial Sequence; identical to SEQ ID NO: 12138
  derived and/or modified CDS sequence (AUadapt) from InfluenzaA__AIM56160__HA

SEQ ID NO: 12952 - RNA, 1701 nt, Artificial Sequence; identical to SEQ ID NO: 10285
  derived and/or modified CDS sequence (AUadapt) from InfluenzaA__AIM56171__HA

SEQ ID NO: 12953 - RNA, 1701 nt, Artificial Sequence
  derived and/or modified CDS sequence (AUadapt) from InfluenzaA__AIM56182__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaaggccagcuccuggcccaaccacgacucgaacaagggggucaccgccgccugcccgcacgcgggcgccaaguccuucuacaagaaccugaucuggcucgugaagaaggggaacagcuaccccaagcugucccagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucacgauggagcgcaacgccgggucgggcaucaucaucuccgacacccccgugcacgacugcaacacgaccugccagaccccggagggcgccaucaacaccagccugcccuuccagaacauccaccccaucaccaucgggaagugccccaaguacgugaaguccaccaagcugcggcucgcgacgggccugcgcaacaucccgucgauccagucccgggggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaacaaggagaagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 12954 - RNA, 1701 nt, Artificial Sequence
  derived and/or modified CDS sequence (AUadapt) from InfluenzaA__AIM56193__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaaggugaccuucgaggcgacgggcaaccucgucgugccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgucaaguccacgaagcugcggcucgccaccggccugcgcaacgugccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 12955 - RNA, 1701 nt, Artificial Sequence; identical to SEQ ID NO: 10285
  derived and/or modified CDS sequence (AUadapt) from InfluenzaA__AIM56204__HA

SEQ ID NO: 12956 - RNA, 1701 nt, Artificial Sequence; identical to SEQ ID NO: 10285
  derived and/or modified CDS sequence (AUadapt) from InfluenzaA__AIM56215__HA

SEQ ID NO: 12957 - RNA, 1701 nt, Artificial Sequence; identical to SEQ ID NO: 10285
  derived and/or modified CDS sequence (AUadapt) from InfluenzaA__AIM56226__HA

SEQ ID NO: 12958 - RNA, 1701 nt, Artificial Sequence; identical to SEQ ID NO: 12696
  derived and/or modified CDS sequence (AUadapt) from InfluenzaA__AIM56237__HA

SEQ ID NO: 12959 - RNA, 1701 nt, Artificial Sequence; identical to SEQ ID NO: 10285
  derived and/or modified CDS sequence (AUadapt) from InfluenzaA__AIM56259__HA

SEQ ID NO: 12960 - RNA, 1701 nt, Artificial Sequence
  derived and/or modified CDS sequence (AUadapt) from InfluenzaA__AIM56270__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccgugaacaccagccugcccuuccagaacauccaccccaucaccaucgggaagugccccaaguacgucaaguccacgaagcugcggcucgccaccggccugcgcaacgugccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggucaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcuggugcuccuggagaacgagcggacgcuggacuaccacgacuccaacgucaagaaccucuacgagaaggugcgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 12961 - RNA, 1701 nt, Artificial Sequence; identical to SEQ ID NO: 10285
  derived and/or modified CDS sequence (AUadapt) from InfluenzaA__AIM56281__HA

SEQ ID NO: 12962 - RNA, 1701 nt, Artificial Sequence
  derived and/or modified CDS sequence (AUadapt) from InfluenzaA__AIM56292__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccucaucuggcuggugaagaaggggaacucguaccccaagcugucccagagcuacaucaacgacaagggcaaggagauccucgugcugugggggauccaccaccccucgaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccucgucgagcccggggacaagaucaccuucgaggcgacgggcaaccugguggugccccgguacgccuucaccauggagcgcaacgccgggagcggcaucaucaucuccgacacccccguccacgacugcaacaccacgugccagaccccggagggcgccaucaacaccucgcugcccuuccagaacauccaccccaucaccaucgggaagugccccaaguacgugaaguccacgaagcuccggcuggccaccggccugcgcaacgugccgagcauccagucccggggccucuucggggcgaucgccggguucaucgagggcggcuggaccgggauggucgacggcugguacggguaccaccaccagaacgagcagggcucgggguacgccgccgaccugaaguccacccagaacgccaucgacaagaucacgaacaaggugaacucggugaucgagaagaugaacacccaguucaccgcggucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacuccaacgugaagaaccuguacgagaaggugcgcaaccagcugaagaacaacgccaaggagaucgggaacggcugcuucgaguucuaccacaagugcgacaacacgugcauggagagcgucaagaacgggaccuacgacuaccccaaguacuccgaggaggccaagcucaaccgggagaagaucgacggcgugaagcuggagucgacccgcaucuaccagauccuggccaucuacuccaccguggcgucgucccucguccugguggugagccugggggccaucucguucuggaugugcuccaacggcagccuccagugccggaucugcaucuga

SEQ ID NO: 12963 - RNA, 1701 nt, Artificial Sequence
  derived and/or modified CDS sequence (AUadapt) from InfluenzaA__AIM56303__HA
augaaggccauccuggugguccuccuguacacccuggccaccgcgaacgccgacacgcucugcaucggcuaccacgccaacaacucgaccgacaccguggacaccgugcuggagaagaacgucacggugacccacuccgugaaccugcucgaggacaagcacaacgggaagcugugcaagcugcgcggcgucgcgccccuccaccuggggaagugcaacaucgccggcuggauccuggggaacccggagugcgagucgcucuccaccgccagcuccuggucguacaucguggagaccuccucguccgacaacggcacgugcuaccccggcgacuucaucaacuacgaggagcugcgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccucaucuggcuggugaagaaggggaacucguaccccaagcugucccagagcuacaucaacgacaagggcaaggaggugcucguccugugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccucguggagcccggggacaagaucaccuucgaggcgacgggcaaccugguggucccccgguacgccuucaccauggagcgcaacgccgggagcggcaucaucaucuccgacacccaggugcacgacugcaacaccacgugccagacccccgagggcgccaucaacaccucgcugccguuccagaacauccaccccaucaccaucgggaagugccccaaguacgugaaguccacgaagcuccggcuggccaccggccugcgcaacguccccagcauccagucccggggccucuucggggcgaucgccggguucaucgagggcggcuggaccgggaugguggacggcugguacggguaccaccaccagaacgagcagggcucgggguacgccgccgaccugaaguccacccagaacgccaucgacaagaucacgaacaaggugaacucggucaucgagaagaugaacacccaguucaccgcggugggcaaggaguucaaccaccuggagaagcgcaucgagaaccucaacaagaaggucgacgacggcuuccuggacaucuggaccuacaacgccgagcugcucgugcugcuggagaacgagcggacgcucgacuaccacgacuccaacgugaagaaccuguacgagaagguccgcaaccagcugaagaacaacgccaaggagaucgggaacggcugcuucgaguucuaccacaagugcgacaacacgugcauggagagcgugaagaacgggaccuacgacuacccgaaguacuccgaggaggccaagcucaaccgggagaagaucgacggcgugaagcuggagucgacccgcaucuaccagauccuggccaucuacuccaccgucgcgucgucccucgugcugguggucagccugggggccaucucguucuggaugugcuccaacggcagccuccagugccggaucugcaucuga

SEQ ID NO: 12964 - RNA, 1701 nt, Artificial Sequence
  derived and/or modified CDS sequence (AUadapt) from InfluenzaA__AIM56314__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaagcucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12965 - RNA, 1701 nt, Artificial Sequence; identical to SEQ ID NO: 10285
  derived and/or modified CDS sequence (AUadapt) from InfluenzaA__AIM56325__HA

SEQ ID NO: 12966 - RNA, 1701 nt, Artificial Sequence
  derived and/or modified CDS sequence (AUadapt) from InfluenzaA__AIM56336__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacaucccgagcauccagucccgggggcuguucggcgcgaucgccggguucaucgagggcggcuggaccgggauggucgacggcugguacggguaccaccaccagaacgagcagggcucgggguacgccgccgaccucaaguccacccagaacgccaucgacaagaucacgaacaaggugaacagcgugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaagauccgcaaccagcugaagaacaacgccaaggagaucgggaacggcugcuucgaguucuaccacaagugcgacaacaugugcauggagucggugaagaacgggaccuacgacuaccccaaguacuccgaggaggccaagcugaaccgggagaagaucgacggcgucaagcucgagagcacccgcaucuaccagauccuggccaucuacuccaccguggcgucgucccuggugcucgucgugagccugggggccaucucguucuggaugugcuccaacggcagccugcagugccggaucugcaucuga

SEQ ID NO: 12967 - RNA, 1701 nt, Artificial Sequence
  derived and/or modified CDS sequence (AUadapt) from InfluenzaA__AIM56347__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccaccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggcgucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgaucgggaagugccccaaguacgugaaguccaccaagcugcggcucgccaccggccugcgcaacgucccgucgauccagucccgggggcuguucggcgccaucgcgggguucaucgagggcggcuggaccgggaugguggacggcugguacggguaccaccaccagaacgagcagggcagcggguacgccgccgaccucaaguccacgcagaacgccaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgcggagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12968 - RNA, 1701 nt, Artificial Sequence
  derived and/or modified CDS sequence (AUadapt) from InfluenzaA__AIM56358__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccuggugaagcccggggacaagaucaccuucgaggcgacgggcaaccucguggucccccgguacgccuucaccauggagcgcaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgucccgucgauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12969 - RNA, 1701 nt, Artificial Sequence; identical to SEQ ID NO: 10285
  derived and/or modified CDS sequence (AUadapt) from InfluenzaA__AIM56369__HA

SEQ ID NO: 12970 - RNA, 1701 nt, Artificial Sequence
  derived and/or modified CDS sequence (AUadapt) from InfluenzaA__AIM56380__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugagccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 12971 - RNA, 1701 nt, Artificial Sequence; identical to SEQ ID NO: 10285
  derived and/or modified CDS sequence (AUadapt) from InfluenzaA__AIM56391__HA

SEQ ID NO: 12972 - RNA, 1701 nt, Artificial Sequence; identical to SEQ ID NO: 10285
  derived and/or modified CDS sequence (AUadapt) from InfluenzaA__AIM56402__HA

SEQ ID NO: 12973 - RNA, 1701 nt, Artificial Sequence; identical to SEQ ID NO: 12138
  derived and/or modified CDS sequence (AUadapt) from InfluenzaA__AIM56413__HA

SEQ ID NO: 12974 - RNA, 1701 nt, Artificial Sequence; identical to SEQ ID NO: 10285
  derived and/or modified CDS sequence (AUadapt) from InfluenzaA__AIM56425__HA

SEQ ID NO: 12975 - RNA, 1701 nt, Artificial Sequence; identical to SEQ ID NO: 10285
  derived and/or modified CDS sequence (AUadapt) from InfluenzaA__AIM56436__HA

SEQ ID NO: 12976 - RNA, 1701 nt, Artificial Sequence; identical to SEQ ID NO: 10285
  derived and/or modified CDS sequence (AUadapt) from InfluenzaA__AIM56447__HA

SEQ ID NO: 12977 - RNA, 1701 nt, Artificial Sequence; identical to SEQ ID NO: 10285
  derived and/or modified CDS sequence (AUadapt) from InfluenzaA__AIM56469__HA

SEQ ID NO: 12978 - RNA, 1701 nt, Artificial Sequence
  derived and/or modified CDS sequence (AUadapt) from InfluenzaA__AIM56480__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgccaaguccuucuacaagaaccugaucuggcucgugaagaaggggaacagcuaccccaagcugucccagucguacaucaacgacaagggcaaggaggugcugguccucugggggauccaccaccccagcacgaccgcggaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucaccauggagcgcaacgccgggucgggcaucaucaucuccgacacccccgugcacgacugcaacacgaccugccagaccccggagggcgccaucaacaccagccugcccuuccagaacauccaccccaucacgcuggggaagugccccaaguacgugaaguccaccaagcuccggcuggccaccggccugcgcaacgucccgucgauccagucccggggccucuucggcgccaucgcgggguucaucgagggcggcuggaccgggaugguggacggcugguacggguaccaccaccagaacgagcagggcagcggguacgccgccgaccugaaguccacgcagaacgccaucgacaagaucaccaacaaggugaacucggucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacuccaacgugaagaaccuguacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcucaaccgggagaagaucgacggcgugaagcuggagagcacccgcaucuaccagauccuggccaucuacuccaccgucgccucgucccucgugcugguggucagccugggggcgaucucguucuggaugugcuccaacggcagccuccagugccggaucugcaucuga

SEQ ID NO: 12979 - RNA, 1701 nt, Artificial Sequence; identical to SEQ ID NO: 10285
  derived and/or modified CDS sequence (AUadapt) from InfluenzaA__AIM56491__HA

SEQ ID NO: 12980 - RNA, 1710 nt, Artificial Sequence
  derived and/or modified CDS sequence (AUadapt) from InfluenzaA__AIM56502__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaaggccagcuccuggcccaaccacgacucgaacaagggggucaccgccgccugcccgcacgcgggcgccaaguccuucuacaagaaccugaucuggcucgugaagaaggggaacagcuaccccaagcugucccagucguacaucaacgacaagggcaaggaggugcugguccucugggggauccaccaccccagcaccaccgccgaccagcagucccuguaccagaacgccgacgccuacguguucgugggcacgucgcgguacuccaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucacgauggagcgcaacgccgggagcggcaucaucaucuccgacacccccgugcacgacugcaacacgaccugccagaccccggagggcgccaucaacaccucgcugaccucccugcccuuccagaacauccaccccaucaccaucgggaagugccccaaguacgucaagagcacgaagcuccggcuggcgaccggccugcgcaacaucccguccauccagucgcgggggcuguucggcgccaucgccggguucaucgagggcggcuggaccgggaugguggacggcugguacggguaccaccaccagaacgagcagggcuccggguacgccgccgaccucaagagcacccagaacgcgaucgacaagaucacgaacaaggugaacuccgugaucgagaagaugaacacccaguucaccgccgucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacucgaacgugaagaaccuguacgagaaggugcgcaaccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggagaagaucgacggcgugaagcuggaguccacccgcaucuaccagauccuggcgaucuacucgaccguggccuccagccucguccugguggugucgcugggggccaucuccuucuggaugugcagcaacggcucccuccagugccggaucugcaucuga

SEQ ID NO: 12981 - RNA, 1701 nt, Artificial Sequence; identical to SEQ ID NO: 10285
  derived and/or modified CDS sequence (AUadapt) from InfluenzaA__AIM56513__HA

SEQ ID NO: 12982 - RNA, 1701 nt, Artificial Sequence; identical to SEQ ID NO: 12230
  derived and/or modified CDS sequence (AUadapt) from InfluenzaA__AIM56524__HA

SEQ ID NO: 12983 - RNA, 1701 nt, Artificial Sequence; identical to SEQ ID NO: 10285
  derived and/or modified CDS sequence (AUadapt) from InfluenzaA__AIM56535__HA

SEQ ID NO: 12984 - RNA, 1701 nt, Artificial Sequence; identical to SEQ ID NO: 10285
  derived and/or modified CDS sequence (AUadapt) from InfluenzaA__AIM56546__HA

SEQ ID NO: 12985 - RNA, 1701 nt, Artificial Sequence; identical to SEQ ID NO: 12138
  derived and/or modified CDS sequence (AUadapt) from InfluenzaA__AIM56557__HA

SEQ ID NO: 12986 - RNA, 1701 nt, Artificial Sequence
  derived and/or modified CDS sequence (AUadapt) from InfluenzaA__AIM56568__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucaacuacgaggagcuccgggagcagcugucguccgugagcuccuucgagcgcuucgagaucuucucgaagaccuccagcuggcccaaccacgacuccaacaagggggucaccgccgccugcccccacgccggcgccaagucguucuacaagaaccugaucuggcucgugaagaaggggaacuccuacccgaagcugagccagucguacaucaacgacaagggcaaggaggugcugguccucugggggauccaccaccccuccaccacggccgaccagcagucgcuguaccagaacgccgacgccuacguguucgugggcaccucccgguacagcaagaaguucaagcccgagaucgccauccgccccaagguccgggaccaggagggccgcaugaacuacuacuggacccugguggagccgggggacaagaucaccuucgaggcgacgggcaaccucguggucccccgguacgccuucaccauggagcgcaacgccggguccggcaucaucaucucggacacccccgugcacgacugcaacaccacgugccagacccccgagggcgccaucaacaccucccugccguuccagaacauccaccccaucaccaucgggaagugccccaaguacgucaagagcacgaagcugcggcucgccaccggccugcgcaacgugcccuccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 12987 - RNA, 1701 nt, Artificial Sequence
  derived and/or modified CDS sequence (AUadapt) from InfluenzaA__AIM56579__HA
augaaggccauccuggugguccuccuguacaccuucgccaccacgaacgcggacacccugugcaucggcuaccacgccaacaacucgaccgacaccguggacacggugcucgagaagaacgucaccgugacccacuccgugaaccugcuggaggacgagcacaacgggaagcucugcaagcugcgcggcgucgcgccccugcaccucgggaagugcaacaucgccggcuggauccuggggaacccggagugcgagucgcuguccaccgccagcuccuggucguacaucguggagacguccagcuccgacaacgggaccugcuaccccggcgacuucaucaacuacgaggagcuccgggagcagcugucguccgugagcuccuucgagcgcuucgagaucuuccccaagaccucguccuggcccaaccacgacagcaacaagggcgucaccgccgccugcccgcacgccggcgccaaguccuucuacaagaaccugaucuggcucgugaagaaggggaacucguaccccaagcugucccagagcuacaucaacgacaagggcaaggaggugcugguccucugggggauccaccaccccucgacgaccgcggaccagcagucccuguaccagaacaccgacgccuacguguucgugggcaccucgcgguacuccaagaaguucaagcccgagaucgccauccgcccgaagguccgggaccaggagggccgcaugagcuacuacuggacgcugguggagcccggggacaagaucaccuucgaggccaccggcaaccucguggucccccgguacgccuucaccauggagcgcaacgcgggguccggcaucaucaucucggacacgcccgugcacgacugcaacacgaccugccagaccccggagggcgccaucaacaccucccugcccuuccagaacauccaccccaucaccaucgggaagugccccaaguacgucaagagcaccaagcugcggcucgccaccggccugcgcaacgugccguccauccagucgcgggggcuguucggcgccaucgccggguucaucgagggcggcuggacggggaugguggacggcugguacggguaccaccaccagaacgagcagggcuccggguacgcggccgaccucaagagcacccagaacgccaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacucgaacgugaagaaccucuacgagaagguccgcaaccagcugaagaacaacgcgaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgccuccagccuggugcucguggucucgcugggggccaucuccuucuggaugugcagcaacggcucccugcagugccggaucugcaucuga

SEQ ID NO: 12988 - RNA, 1710 nt, Artificial Sequence
  derived and/or modified CDS sequence (AUadapt) from InfluenzaA__AIM56590__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugaccucccugcccuuccagaacauccaccccaucacgaucgggaagugccccaaguacgucaagagcaccaagcuccggcuggccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacucgaacgugaagaaccuguacgagaagguccgcaaccagcugaagaacaacgccaaggagaucgggaacggcugcuucgaguucuaccacaagugcgacgacacgugcauggaguccgugaagaacgggaccuacgacuaccccaaguacagcgaggaggccaagcucaaccgggagaagaucgacggcgugaagcuggaguccacccgcaucuaccagauccuggccaucuacucgaccgucgcguccagccucgugcugguggucucgcugggggccaucuccuucuggaugugcagcaacggcucccuccagugccggaucugcaucuga

SEQ ID NO: 12989 - RNA, 1710 nt, Artificial Sequence
  derived and/or modified CDS sequence (AUadapt) from InfluenzaA__AIM56601__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugaccucccugcccuuccagaacauccaccccaucacgaucgggaagugccccaaguacgucaagagcaccaagcuccggcuggccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgcggugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacucgaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacucgaccgucgcguccagccucgugcugguggucucgcugggggccaucuccuucuggaugugcagcaacggcucccuccagugccggaucugcaucuga

SEQ ID NO: 12990 - RNA, 1710 nt, Artificial Sequence
  derived and/or modified CDS sequence (AUadapt) from InfluenzaA__AIM56612__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacaccgggagcggcaucaucaucuccgacacccccgugcacgacugcaacacgaccugccagaccccggagggcgccaucaacaccucgcugacgucccugcccuuccagaacauccaccccaucaccaucgggaagugccccaaguacgucaagagcaccaagcuccggcuggccaccggccugcgcaacgugccguccauccagucgcgggggcuguucggcgccaucgcgggguucaucgagggcggcuggacggggaugguggacggcugguacggguaccaccaccagaacgagcagggcuccggguacgccgccgaccucaagagcacccagaacgccaucgacaagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgcggagcugcucgugcugcuggagaacgagcggacccucgacuaccacgacucgaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacucgaccgucgccuccagccucgugcugguggucucgcugggggcgaucuccuucuggaugugcagcaacggcucccuccagugccggaucugcaucuga

SEQ ID NO: 12991 - RNA, 1701 nt, Artificial Sequence
  derived and/or modified CDS sequence (AUadapt) from InfluenzaA__AIM56623__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaccuggcucgugaagaaggggaacucguaccccaagcugucccagagcuacaucaacgacaagggcaaggaggugcugguccucugggggauccaccaccccucgacgaccgccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucacguucgaggcgaccggcaaccucguggucccccgguacgccuucaccauggagcgcaacgccgggagcggcaucaucaucuccgacacccccgugcacgacugcaacacgaccugccagaccccggagggcgccaucaacaccucgcugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacgcagaacgccaucgacaagaucaccaacaaggugaacucggucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 12992 - RNA, 1701 nt, Artificial Sequence
  derived and/or modified CDS sequence (AUadapt) from InfluenzaA__AIM56634__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgaacagcugguccuacaucguggagaccucguccucggacaacggcacgugcuaccccggcgacuucaucaacuacgaggagcuccgggagcagcuguccagcguguccucguucgagcgcuucgagaucuuccccaagaccuccagcuggcccaaccacgacuccaacaagggggucaccgccgccugcccgcacgccggcgccaagucguucuacaagaaccugaucuggcucgugaagaaggggaacuccuaccccaagcugucgcaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagucgacgaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcucgaguccacccgcaucuaccagauccuggccaucuacucgaccgucgcguccagccuggugcucguggucucccugggggccaucucguucuggaugugcagcaacggcucccugcagugccggaucugcaucuga

SEQ ID NO: 12993 - RNA, 1710 nt, Artificial Sequence
  derived and/or modified CDS sequence (AUadapt) from InfluenzaA__AIM56645__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcugucccagagcuacaucaacgacaagggcaaggaggugcugguccucugggggauccaccaccccucgaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccgggagcggcaucaucaucuccgacacccccgugcacgacugcaacaccacgugccagaccccggagggcgccaucaacaccucgcugaccucccugcccuuccagaacauccaccccaucacgaucgggaagugccccaaguacgucaagagcaccaagcuccggcuggccaccggccugcgcaacgugccguccauccagucgcggggccucuucggggcgaucgccggguucaucgagggcggcuggaccgggaugguggacggcugguacggguaccaccaccagaacgagcagggcuccggguacgccgccgaccagaaguccacgcagaacgccaucgacaagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 12994 - RNA, 1701 nt, Artificial Sequence
  derived and/or modified CDS sequence (AUadapt) from InfluenzaA__AIM56656__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccucguccgacaacggcacgugcuaccccggcgacuucaucaacuacgaggagcuccgggagcagcugagcuccgugucguccuucgagcgcuucgagaucuuccccaagaccaacagcuggcccaaccacgacuccaacaagggggucaccgccgccugcccgcacgccggcgccaagucguucuacaagaaccugaucuggcucgugaagaaggggaacuccuaccccaagcugucgcaguccuacaucaacgacaagggcaaggaggugcugguccucugggggauccaccaccccagcaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaacaucguggucccccgguacgccuucaccauggagcgcaacgccggguccggcaucaucaucucggacacccccgugcacgacugcaacaccacgugccagaccccggagggcgccaucaacaccucccuccccuuccagaacauccaccccaucaccaucgggaagugccccaaguacgucaagucgacgaagcugcggcuggccaccggccuccgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucgggaacggcugcuucgaguucuaccacaagugcgacaacacgugcauggaguccgugaagaacgggaccuacgacuaccccaaguacucggaggaggccaagcugaaccgggagaagaucgacggcgugaagcuggaguccacccgcaucuaccagauccucgccaucuacucgaccgucgcguccagccuggugcugguggucucccucggggccaucucguucuggaugugcagcaacggcucccugcagugccggaucugcaucuga

SEQ ID NO: 12995 - RNA, 1701 nt, Artificial Sequence; identical to SEQ ID NO: 10285
  derived and/or modified CDS sequence (AUadapt) from InfluenzaA__AIM56667__HA

SEQ ID NO: 12996 - RNA, 1701 nt, Artificial Sequence
  derived and/or modified CDS sequence (AUadapt) from InfluenzaA__AIM56678__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgugcccccgcugcaccucgggaagugcaacaucgccggcuggauccuggggaaccccgagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggccgaaccacgacucgaacaagggggucaccgcggccugcccccacgccggcgccaaguccuucuacaagaaccugaucuggcucgugaagaaggggaacagcuaccccaagcugucccagucguacaucaacgacaagggcaaggaggugcugguccucugggggauccaccaccccagcaccacggcggaccagcagucccuguaccagaacgccgacgccuacguguucgugggcaccucgcgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucaccauggagcgcaacgccgggucgggcaucaucaucuccgacaccccggugcacgacugcaacaccacgugccagacccccgagggcgccaucaacaccagccugcccuuccagaacauccaccccaucaccaucgggaagugcccgaaguacgugaaguccacgaagcugcggcucgccaccggccugcgcaacguccccucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgccgugggcaaggaguucaaccaccuggagaagcgcaucgagaaccugaacaagaaggucgacgacggcuuccucgacaucuggaccuacaacgcggagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggagaagaucgacggcgugaagcucgagagcacccgcaucuaccagauccuggccaucuacuccaccgucgccucgucccuggugcucguggucagccugggggcgaucucguucuggaugugcuccaacggcagccugcagugccggaucugcaucuga

SEQ ID NO: 12997 - RNA, 1701 nt, Artificial Sequence; identical to SEQ ID NO: 12633
  derived and/or modified CDS sequence (AUadapt) from InfluenzaA__AIM56689__HA

SEQ ID NO: 12998 - RNA, 1701 nt, Artificial Sequence; identical to SEQ ID NO: 10285
  derived and/or modified CDS sequence (AUadapt) from InfluenzaA__AIM56700__HA

SEQ ID NO: 12999 - RNA, 1710 nt, Artificial Sequence
  derived and/or modified CDS sequence (AUadapt) from InfluenzaA__AIM56711__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgugcccccgcugcaccucgggaagugcaacaucgccggcuggauccuggggaaccccgagugcgagagccuguccaccgccucguccuggagcuacaucguggagaccuccucguccgacaacggcacgugcuaccccggcgacuucaucaacuacgaggagcuccgggagcagcugagcuccgugucguccuucgagcgcuucgagaucuuccccaagaccagcuccuggccgaaccacgacucgaacaagggggucaccgcggccugcccccacgccggcgccaaguccuucuacaagaaccugaucuggcucgugaagaaggggaacagcuaccccaagcugucccagucguacaucaacgacaagggcaaggaggugcugguccucugggggauccaccaccccagcaccacggcggaccagcagucccuguaccagaacgccgacgccuacguguucgugggcaccucgcgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucaccauggagcgcaacgccgggagcggcaucaucaucuccgacaccccggugcacgacugcaacaccacgugccagacccccgagggcgccaucaacaccucgcugaccucccugcccuuccagaacauccaccccaucacgaucgggaagugcccgaaguacgucaagagcaccaagcuccggcuggccaccggccugcgcaacguccccuccauccagucgcgggggcuguucggcgccaucgcgggguucaucgagggcggcuggaccgggaugguggacggcugguacggguaccaccaccagaacgagcagggcuccggguacgccgccgaccucaagagcacgcagaacgccaucgacaagaucaccaacaaggugaacuccgucaucgagaagaugaacacccaguucaccgccgugggcaaggaguucaaccaccuggagaagcgcaucgagaaccucaacaagaaggucgacgacggcuuccuggacaucuggacguacaacgcggagcugcucgugcugcuggagaacgagcggacccucgacuaccacgacucgaacgugaagaaccuguacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggagaagaucgacggcgugaagcuggaguccacccgcaucuaccagauccuggccaucuacucgaccgucgccuccagccucgugcugguggucucgcugggggcgaucuccuucuggaugugcagcaacggcucccuccagugccggaucugcaucuga

SEQ ID NO: 13000 - RNA, 1701 nt, Artificial Sequence; identical to SEQ ID NO: 12633
  derived and/or modified CDS sequence (AUadapt) from InfluenzaA__AIM56722__HA

SEQ ID NO: 13001 - RNA, 1701 nt, Artificial Sequence; identical to SEQ ID NO: 10285
  derived and/or modified CDS sequence (AUadapt) from InfluenzaA__AIM56733__HA

SEQ ID NO: 13002 - RNA, 1701 nt, Artificial Sequence; identical to SEQ ID NO: 10285
  derived and/or modified CDS sequence (AUadapt) from InfluenzaA__AIM56744__HA

SEQ ID NO: 13003 - RNA, 1701 nt, Artificial Sequence
  derived and/or modified CDS sequence (AUadapt) from InfluenzaA__AIM56755__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccagccacgacuccaacaagggggucaccgccgccugcccgcacgccggcgccaagucguucuacaagaaccugaucuggcucgugaagaaggggaacuccuaccccaagcugagccagucguacaucaacgacaagggcaaggaggugcugguccucugggggauccaccaccccuccaccacggccgaccagcagucgcuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagcgcaacgccggguccggcaucaucaucucggacacccccgugcacgacugcaacaccacgugccagaccccggagggcgccaucaacaccucccugcccuuccagaacauccaccccaucaccaucgggaagugccccaaguacgucaagagcacgaagcugcggcucgccaccggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagagcacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacucgaacgugaagaaccucuacgagaagguccgcaaccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggagaagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 13004 - RNA, 1710 nt, Artificial Sequence; identical to SEQ ID NO: 12989
  derived and/or modified CDS sequence (AUadapt) from InfluenzaA__AIM56766__HA

SEQ ID NO: 13005 - RNA, 1701 nt, Artificial Sequence
  derived and/or modified CDS sequence (AUadapt) from InfluenzaA__AIM56777__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggggaagcacaacggcaagcucugcaagcugcgcggggucgcgccccugcaccucggcaagugcaacaucgccggguggauccugggcaacccggagugcgagucgcuguccaccgccagcuccuggucguacaucguggagaccuccucguccgacaacggcacgugcuaccccggggacuucaucaacuacgaggagcuccgggagcagcugagcuccgugucguccuucgagcgcuucgagaucuuccccaagaccagcuccuggcccaaccacgacucgaacaagggcgucaccgccgccugcccgcacgccggggcgaaguccuucuacaagaaccugaucuggcucgugaagaagggcaacucguaccccaagcugucccagagcuacaucaacgacaaggggaaggaggugcugguccucuggggcauccaccaccccucgaccacggccgaccagcagucccuguaccagaacgccgacgccuacguguucgugggcaccucgcgguacuccaagaaguucaagcccgagaucgccauccgcccgaagguccgggaccaggaggggcgcaugaacuacuacuggacccugguggagcccggcgacaagaucaccuucgaggcgacggggaaccucguggucccccgguacgccuucaccauggagcgcaacgccggcagcggcaucaucaucuccgacacccccgugcacgacugcaacaccacgugccagaccccggagggggccaucaacaccucgcugcccuaccagaacauccaccccaucaccaucggcaagugccccaaguacgugaaguccacgaagcugcggcucgccaccgggcugcgcaacgucccgagcauccagucccggggccuguucggggcgaucgccggcuucaucgagggcggguggaccggcaugguggacgggugguacggcuaccaccaccagaacgagcaggggucgggcuacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggagaagaucgacggggugaagcucgagucgacccgcaucuaccagauccuggccaucuacuccaccgucgcgucgucccuggugcucguggucagccugggcgccaucucguucuggaugugcuccaacggcagccugcagugccggaucugcaucuga

SEQ ID NO: 13006 - RNA, 1701 nt, Artificial Sequence; identical to SEQ ID NO: 10285
  derived and/or modified CDS sequence (AUadapt) from InfluenzaA__AIM56788__HA

SEQ ID NO: 13007 - RNA, 1701 nt, Artificial Sequence; identical to SEQ ID NO: 10285
  derived and/or modified CDS sequence (AUadapt) from InfluenzaA__AIM56799__HA

SEQ ID NO: 13008 - RNA, 1701 nt, Artificial Sequence; identical to SEQ ID NO: 10285
  derived and/or modified CDS sequence (AUadapt) from InfluenzaA__AIM56810__HA

SEQ ID NO: 13009 - RNA, 1701 nt, Artificial Sequence; identical to SEQ ID NO: 10285
  derived and/or modified CDS sequence (AUadapt) from InfluenzaA__AIM56821__HA

SEQ ID NO: 13010 - RNA, 1683 nt, Artificial Sequence
  derived and/or modified CDS sequence (AUadapt) from InfluenzaA__AIN76383__HA
augaauacccaaauccugguguucgcccucaucgccaucguccccaccaacgcggacaagaucugccugggccaccacgccgugagcaacgggacgaaggugaauacccugaccgagcgcggcgucgagguggugaacgccaccgagacggucgagcggaccaacaucccgcgcaucugcuccaaggggaagaagaccguggaccucggccagugcgggcugcugggcaccaucacgggcccgccccagugcgaccaguuccucgaguucagugccgaccugaucaucgagcggcgcgagggguccgacgugugcuaccccggcaaguucgucaacgaggaggcccugcggcagauccuccgcgagagcgggggcaucgacaaggaggcgaugggguuuaccuacuccggcauccggaccaacggcaccacgagcgccugccgccgguccgggagcuccuucuacgccgagaugaaguggcugcugagcaacaccgauaacgccgcguucccccagaugaccaaguccuacaagaacacccgcaagagccccgcccucaucguguggggcauccaccacuccgugagcacggccgagcagaccaagcuguauggguccggcaacaagcuggucaccgugggcagcuccaacuaccagcagagcuucgugcccucccccggggcccggccgcaggucaacggccucagcgggcgcaucgacuuucacuggcugaugcugaaccccaacgacaccgugacguucagcuucaacggcgccuuuaucgcgcccgaccgggccuccuuccuccgcggcaagagcauggggauccaguccggcgugcaggucgacgccaacugcgagggggacugcuaccauagcggcgggaccaucaucuccaaccugcccuuccagaacaucgacagccgggccgugggcaagugcccgcgcuacgugaagcagaagucccugcuccuggccaccgggaugaaaaauguccccgagauccccaagggccggggccuguucggggcgaucgccggcuucaucgagaacgggugggagggccucaucgacgggugguacggcuuccgccaccagaacgcccagggcgaggggaccgccgccgacuauaagagcacgcaguccgcgaucgaccagaucaccggcaagcugaaccggcugaucgagaagaccaaccagcaguucgagcucaucgacaacgaguucaaugagguggagaagcagaucgggaacgugaucaacuggacccgcgacagcaucacggaggucugguccuacaacgccgagcugcugguggccauggagaaccagcacaccaucgaccucgccgauagcgagauggacaagcuguacgagcgggucaagcgccagcugcgcgagaacgccgaggaggacggcaccggcugcuucgagaucuuccauaagugcgacgacgacugcauggcguccauccggaacaacaccuacgaccauagcaaguaccgcgaggaggccaugcagaaccggauccagaucgaccccgugaagcucuccagcggguacaaggacgugauccugugguucuccuuuggcgccagcugcuucauccugcucgccaucgucauggggcugguguucaucugcgugaagaacggcaacaugcgcugcacgaucugcaucuga

SEQ ID NO: 13011 - RNA, 1689 nt, Artificial Sequence
  derived and/or modified CDS sequence (AUadapt) from InfluenzaA__AIP93103__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagcuucaacgacuacgaggagcugaagcaccuccuguccucggugaagcacuucgagaaggugaagauccugcccaaggacggguggacgcagcacgagaccgacggcggguccaaggccugcgccgucucgggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccagaacguggggacguacgugucggccuccaccucgacccugaacaagcgcuccacccccgagaucgcggcccggcccaaggucagcggccucgggucccgcauggaguucucguggacgcugcuggacgugugggacaccaucuccuucgagucgaccggcaaccucguggccccggaguacggcuucaagaucagcaagcggggguccucgggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggcccccgcaacgucccccagaucgagucgcgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacucggucaucgagaagaugaacacccaguucgaggcggugggcaaggaguucuccaaccuggagaagcggcucgagaaccugaacaagaagauggaggacggguuccuggacguguggaccuacaacgccgagcuccugguccugauggagaacgagcgcacccucgacuuccacgacucgaacgugaagaaccuguacgacaagguccggaugcagcugcgcgacaacgugaaggagcucggcaacggcugcuucgaguucuaccacaagugcgacgacgagugcaugaacuccgugaagaacgggacguacgacuaccccaaguacgaggaggagagcaagcugaagcggaacgagaucaagggcgucaagcuguccucgauggggguguaccagauccucgccaucuacgccaccguggccggcucccugucgcuggcgaucaugaucgccggcaucuccuucuggaugugcagcaacgggucccuccagugccgcaucugcaucuga

SEQ ID NO: 13012 - RNA, 1689 nt, Artificial Sequence; identical to SEQ ID NO: 1900
  derived and/or modified CDS sequence (AUadapt) from InfluenzaA__AIP93115__HA

SEQ ID NO: 13013 - RNA, 1701 nt, Artificial Sequence
  derived and/or modified CDS sequence (AUadapt) from InfluenzaA__AIR93971__HA
augaaggccauccuggugguccuccuguacaccuucgccaccacgaacgcggacauccugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcccgguccuucuacaagaaccugaucuggcucgugaagaaggggaacucguaccccaagcuguccaagagcuacaucaacgacaagggcaaggaggugcugguccucugggggauccaccaccccucgaccuccgcggaccagcagagccuguaccagaacgccgacgccuacguguucgugggcacgucccgcuacucgaagaaguucaagcccgagaucgccauccggccgaagguccgcgaccgggagggccgcaugaacuacuacuggacccugguggagcccggggacaagaucaccuucgaggccaccggcaaccucguggucccccgguacgcguucgccauggagcgcaacgccggguccggcaucaucacgagcgacacccccgugcacgacugcaacacgaccugccagaccccgaagggcgccaucaacaccucccugcccuuccagaacauccaccccaucaccaucgggaagugccccaaguacgucaagucgaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 13014 - RNA, 1701 nt, Artificial Sequence
  derived and/or modified CDS sequence (AUadapt) from InfluenzaA__AIR93982__HA
augaaggccauccuggugguccuccuguacaccaucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacucgaacaagggggucaccgccgccugcccgcacgccggcgcgcgguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgcuacagcaagaaguucaagcccgagaucgccauccggccgaagguccgcgaccgggagggccgcaugaacuacuacuggacccugguggagcccggggacaagaucaccuucgaggcgaccggcaaccucguggucccccgguacgccuucacgauggagcgcaacgccggguccggcaucaucaucucggacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagucgcgggggcuguucggcgcgaucgccggguucaucgagggcggcuggaccgggaugguggacggcugguacggguaccaccaccagaacgagcagggcuccggguacgccgccgaccucaagucgacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagacgaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgagccuggugcucguggucucccugggggccaucucguucuggaugugcuccaacggcagccugcagugccggaucugcaucuga

SEQ ID NO: 13015 - RNA, 1701 nt, Artificial Sequence
  derived and/or modified CDS sequence (AUadapt) from InfluenzaA__AIR93993__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcggcagccuguccaccgccucguccuggagcuacaucguggagaccuccagcuccgacaacggcacgugcuaccccggggacuucaucgacuacgaggagcuccgcgagcagcugucguccgugagcuccuucgagcgguucgagaucuuccccaagaccucguccuggcccaaccacgacagcaacaagggcgucaccgccgccugcccgaacgccggguccaagagcuucuacaagaaccugaucuggcucgugaagaagggcaacuccuaccccaagcugucgaagagcuacaucaacgacaaggggaaggaggugcugguccucuggggcauccaccaccccuccaccucggcggaccagcagucccuguaccagaacgccgacgccuacguguucgugggcacgagccgcuacuccaagaaguucaagcccgagaucgccauccggccgaagguccgcgggcaggagggccggauggacuacuacuggacccugguggagcccggggacaagaucaccuucgaggccaccggcaaccucguggucccccgcuacgcguucgccauggagcggaacacgggcagcgggaucaucaucuccgacacccccgugcacgacugcaacaccaucugccagaccccgaagggcgccaucaacacgucgcugcccuuccagaacauccaccccaucaccaucgggaagugccccaaguacgugaaguccaccaagcugcgccucgccaccggccugcggaacgucccgagcauccagucccgcgggcuguucggcgccaucgcgggcuucaucgagggcggguggacggggaugguggacggcugguacggguaccaccaccagaacgagcagggcucgggcuacgccgccgaccucaaguccacccagaacgccaucgacgagaucaccaacaaggugaacagcgucaucgagaagaugaacacccaguucacggccguggggaaggaguucaaccaccuggagaagcggaucgagaaccugaacaagaaggucgacgacggcuuccucgacaucuggaccuacaacgcggagcugcuggugcuccuggagaacgagcgcacccuggacuaccacgacuccaacgugaagaaccucuacgagaagguccggagccagcugaagaacaacgccaaggagaucgggaagggcugcuucgaguucuaccacaagugcgacaccaugugcauggaguccgugaagaacgggacguacgacuaccccaaguacucggaggaggccaagcugaaccgcgaggagaucgacggcgugaagcucgaguccacccggaucuaccagauccuggccaucuacagcaccgucgccucgucccuggugcucguggucagccugggcgcgaucuccuucuggaugugcagcaacgggucccugcagugccgcaucugcaucuga

SEQ ID NO: 13016 - RNA, 1701 nt, Artificial Sequence
  derived and/or modified CDS sequence (AUadapt) from InfluenzaA__AIR94000__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccuccuuccccuuccagaacauccaccccaucaccaucgggaagugccccaaguacgucaagagcaccaagcugcggcuggcgaccggccuccgcaacgugccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacucgaacgugaagaaccuguacgagaagguccgcucccagcucaagaccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgcgaucuacuccaccgucgccagcucgcuggugcugguggucucccucggggccaucagcuucuggaugugcuccaacggcagccugcagugccggaucugcaucuga

SEQ ID NO: 13017 - RNA, 1683 nt, Artificial Sequence
  derived and/or modified CDS sequence (AUadapt) from InfluenzaA__AIR94116__HA
auggagaccgccucgcugaucaccauccuccugguggucacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccacccgcugauccuggacacgugcaccaucgaggggcucaucuacggcaaccccuccugcgaccugcugcucgggggccgcgaguggucguacaucguggagcggcccuccgccgucaacggccugugcuaccccgggaacguggagaaccuggaggagcuccgcucgcuguucuccucggcccgguccuaccagcgcauccagaucuucccggacaccaucuggaacgugucguacuccggcaccucgaaggccugcuccgacucguucuaccgguccaugcgcuggcugacccagaaggacaacgcguaccccauccaggacgcccaguacaccaacaaccaggggaagaacauccucuucauguggggcaucaaccacccgcccaccgacacggcccagaccaaccuguacacccggaccgacacgaccaccucggucgccaccgaggagaucaaccgcacguucaagccccugaucgggccccggccccucgugaacggccugaugggccgcaucaacuacuacugguccgugcugaagcccgggcagacccuccggaucaagagcaacggcaaccugaucgcgccgugguacgggcacauccugucgggcgagucccacggccgcauccucaagaccgaccugaagcgggggucgugcaccguccagugccagacggagaagggcgggcugaacaccacccuccccuuccagaacguguccaaguacgccuucggcaacugcucgaaguacaucgggaucaagucccugaagcuggccgugggccuccgcaacguccccucgcgguccucgcgcggccuguucggggccaucgccggcuucaucgagggcgggugguccgggcugguggcgggcugguacggcuuccagcacucgaacgaccagggggugggcauggccgccgaccgggacuccacccagaaggccaucgacaagaucacgucgaaggucaacaacaucguggacaagaugaacaagcaguacgagaucaucgaccacgaguucaacgagguggagacccgccucaacaugaucaacaacaagaucgacgaccagauccaggacaucugggccuacaacgcggagcugcugguccuccuggagaaccagaagacccuggacgagcacgacgccaacgugaacaaccucuacaacaaggugaagcgggcccugggguccaacgccgucgaggacggcaaggggugcuucgagcuguaccacaagugcgacgaccagugcauggagaccauccgcaacggcacguacaaccggcgcaaguaccaggaggagucgaagcucgagcgccagaagaucgagggcgugaagcuggaguccgaggggaccuacaagauccugaccaucuacucgaccgucgccuccucgcucgugaucgcgaugggcuucgccgccuuccuguucugggccauguccaacgggagcugccggugcaacaucugcaucuga

SEQ ID NO: 13018 - RNA, 1701 nt, Artificial Sequence
  derived and/or modified CDS sequence (AUadapt) from InfluenzaA__AIT38333__HA
augaagaccaucaucacccugucguacauccucugccacguguucgcccagaagauccacggcuccgacucguccacggccacccugugccuggggcaccacgcgguccccaacggcacccucgugaagaccaucacgaacgaccagaucgaggugaccaacgccaccgagcugguccagagcuccucgaccgggcgcaucugcgacaacccgcaccggauccuggacggcaagaacugcacgcucaucgacgcccugcugggggacccccacugcgacgaguuccagaacaaggagugggaccucuucguggagcgcuccaacgccuacagcgacugcuaccccuacuacgugcccgacuacgccucccugcggucgcuggucgcguccagcggcacccucgaguucaacaacgaguccuucaacuggaccggcaucucgcaggacgggaccuccagcuccugccgccggggcucggugaaguccuucuucagccgccugaacuggcugcacgggcucgaguacaaguacccggcccagaacgugacgaugcugaacaacgacgaguucgacaagcuguacaucuggggcguccaccaccccucgaccgacuccgaccagaccucgcucuacgugcagaccuccgggcgggugacggucagcaccaagcgcucccagcagaccgugauccccaacaucggcucgcggcccugggugcgcggcaucuccagccggaucuccauccacuggaccaucgucaagccgggggacauccugcugaucaacucgacgggcaaccucaucgcgccccgcggguacuucaagauccggggcggcaaguccagcaucaugcgcuccgacgcccccaucgacaacugcgacucggagugcgugacccccaacgggaacaucccgaacgacaagcccuuccagaacgugaaccggaucaccuacggccccugcccccgcuacaucaagcagaacacccugaagcuggccacggggaugcggaacgucccggagaagcagacccgcggcgugcucggggccaucgccggcuucaucgagaacggcugggaggggaugguggacggcugguacggguuccggcaccagaacuccgagggcaccgggcaggccgccgaccucaagagcacccaggcggccaucgaccagaucaacggcaagcugaaccgccugaucggcaagacgaacgagaaguuccaccagaucgagaaggaguucuccgagaucgaggggcggguccaggaccuggagaaguacguggaggacaccaagaucgaccuguggucguacaacgccgagcuccuggugguccuggagaaccagcacaccaucgaccucaccgacuccgagaugaacaagcuguucgagcgcacgcgccggcagcugcgcgagaacgccgaggacaugggcaacgggugcuucaagaucuaccacaagugcgacaacgccugcaucggcagcauccggaacgggaccuacgugcacgacgucuaccgcgacgaggcgcucaacaaccgguuccagaucaagggcguggagcucaagucgggcuacaaggacuggauccuguggaucuccuucgccaucagcugcuuccugcugugcgccgugcugcucggguucaucaccugggccugccagaagggcaacauccgcugcaacaucugcaucuga

SEQ ID NO: 13019 - RNA, 1698 nt, Artificial Sequence
  derived and/or modified CDS sequence (AUadapt) from InfluenzaA__AIT38344__HA
augaagaucaagcugcucauccugcugugcaccuucaccgccacguacgccgacaccaucugcaucggcuaccacgcgaacaacucgaccgacaccguggacacgguccucgagaagaacgugaccgugacccacuccgucaaccugcuggaggacagccacaacgggaagcucugccugcugcgcggcaucgcgccccuccagcuggggaacugcuccguggccggcuggauccuggggaacccggagugcgagagccucaucuccaaggagagcugguccuacaucguggagaagcccaaccccgagaacgggaccugcuaccccggcuacuucgccgacuacgaggagcugcgggagcagcugagcuccgucagcuccuucgagcgcuucgagaucuucccgaaggagucguccuggcccaaccacacggugaccggggugagcgccuccugcagcuacaacggcaaggggaacuucuacaagaaccuccuguggcugacccggaagaacggccucuaccccaaccuguccaagagcuacaccaacaacaaggagaaggagguccugauccucuggggcgugcaccaccccuccaacaucaaggaccagcgcacgcuguaccacaccgagaacgccuacgugagcgucgugagcucccacuacucgcggcgcuucaccccggagaucaccaagcggcccaaggugcgcgaccaggagggccggaucaacuacuacuggacgcugcucgagcccggcgacaccaucaucuucgaggccaacgggaaccugaucgcccccugguacgccuucgcgcugucccgcggcuucgggagcggcaucaucaccuccaacgccccgauggacgagugcgaggccaagugccagacgccccggggcgccaucaacagcucccuccccuuccagaacguccaccccgugaccaucggggagugcccgaaguacgugcgcagcgccaagcugcggauggucaccggccugcgcaacauccccuccauccagagccggggccucuucggggcgaucgccggguucaucgagggcggcuggaccgggaugaucgacggcugguacggguaccaccaccagaacgagcagggcuccggguacgccgccgacaaggagagcacccagaacgccaucaacggcaucacgaacaaggugaacuccgugaucgagaagaugaacacccaguucaccaccgucggcaaggaguucaacaagcuggagcgccggauggagaaccugaacaagaagguggacgacggguuccucgacaucuggacguacaacgcggagcugcuggugcuccuggagaacgagcgcacccuggacuuccacgacucgaacgucaagauccucuacgagaaggugaagucccagcugaagaacaacgccaaggagaucggcaacgggugcuucgaguucuaccacaagugcaacaacgagugcauggagagcgucaagaacggcaccuacgacuaccccaaguacuccgaggagagcaagcugaaccgggagaagaucgacggggugaagcucgaguccaugggcguguaccagauccuggccaucuacagcaccgucgccagcucccuggugcuccuggugagccugggcgccaucuccuucuggaugugcagcaacgggucccuccagugccgcaucugcaucuga

SEQ ID NO: 13020 - RNA, 1698 nt, Artificial Sequence
  derived and/or modified CDS sequence (AUadapt) from InfluenzaA__AIT38360__HA
augaagaucaagcugcucauccugcugugcaccuucaccgccacguacgccgacaccaucugcaucggcuaccacgcgaacaacucgaccgacaccguggacacgguccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucguggagaagcccaaccccgagaacgggaccugcuaccccggcuacuucgccgacuacgaggagcugcgcgagcagcugucguccgucagcuccuucgagcgguucgagaucuucccgaaggagagcuccuggcccaaccacacggugaccggggugagcgccuccugcucguacaacggcaaggggaacuucuacaagaaccuccuguggcugacccgcaagaacggccucuaccccaaccuguccaagagcuacaccaacaacaaggagaaggagguccugauccucuggggcgugcaccaccccuccaacaucgaggaccagcggacgcuguaccacaccgagaacgccuacgugagcgucgugagcucccacuacucgcgccgguucaccccggagaucaccaagcgccccaaggugcggggccaggagggccgcaucaacuacuacuggacgcugcucgagcccggggacaccaucaucuucgaggccaacggcaaccugaucgcccccugguacgccuucgcgcugucccgggggcucggcagcggcaucaucaccuccaacgccccgauggacgagugcgaggccaagugccagacgccccgcggggccaucaacagcucccugcccuuccagaacguccaccccgugaccaucggcgagugcccgaaguacgugcggagcgccaagcugcgcauggucaccgggcuccggaacauccccuccauccagucgcgcggccuguucggggcgaucgccggcuucaucgagggcggguggaccggcaugaucgacgggugguacggcuaccaccaccagaacgagcagggguccggcuacgccgccgacaaggagagcacccagaacgccaucaacggcaucacgaacaaggugaacuccgugaucgagaagaugaacacccaguucaccaccgucgggaaggaguucaacaagcuggagcggcgcauggagaaccucaacaagaagguggacgacggcuuccuggacaucuggacguacaacgcggagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgucaagaacgggaccuacgacuaccccaaguacuccgaggagucgaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 13021 - RNA, 1701 nt, Artificial Sequence; identical to SEQ ID NO: 10285
  derived and/or modified CDS sequence (AUadapt) from InfluenzaA__AIT93147__HA

SEQ ID NO: 13022 - RNA, 1701 nt, Artificial Sequence; identical to SEQ ID NO: 116
  derived and/or modified CDS sequence (AUadapt) from InfluenzaA__AIU39700__HA

SEQ ID NO: 13023 - RNA, 1701 nt, Artificial Sequence
  derived and/or modified CDS sequence (AUadapt) from InfluenzaA__AIU39702__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucucggacacgcccgugcacgacugcaacacgaccugccagaccccgaagggcgccaucaacaccuccuuccccuuccagaacauccaccccaucaccaucgggaagugccccaaguacgucaagagcaccaagcugcggcuggcgaccggccuccgcaacaucccguccauccagucgcgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacucgaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagucgacccgcaucuaccagauccucgcgaucuacuccaccguggccagcucgcugguccugguggugucccucggggccaucagcuucuggaugugcuccaacggcagccugcagugccggaucugcaucuga

SEQ ID NO: 13024 - RNA, 1701 nt, Artificial Sequence; identical to SEQ ID NO: 7154
  derived and/or modified CDS sequence (AUadapt) from InfluenzaA__AIU39704__HA

SEQ ID NO: 13025 - RNA, 1704 nt, Artificial Sequence
  derived and/or modified CDS sequence (AUadapt) from InfluenzaA__AIU46609__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccugaacggcgugaagccccucauccugaaggacugcuccgucgccggguggcugcucggcaacccgaugugcgacgaguucauccgcgugcccgaguggagcuacaucguggagcgggccaaccccgccaacgaccugugcuaccccgggaaccugaacgacuacgaggagcucaagcaccuccugucccgcaucaaccacuucgagaagauccugaucauccccaagucguccuggaccaaccacgagacgagccugggcgucuccgccgcgugcccguaccagggcacccccucguucuuccggaacgugguguggcugaucaagaagaacgacgccuaccccaccaucaagaucuccuacaacaacaccaaccaggaggaccuccugauccugugggggauccaccacagcaacaacgccgccgagcagacgaaccucuacaagaacccgaccaccuacaucuccgucggcaccucgacgcugaaccagcgccuggugcccaagaucgcgacccggucccaggugaacgggcagcgcggccggauggacuucuucuggaccauccucaagcccaacgacgccauccacuucgagagcaacgggaacuucaucgcccccgaguacgccuacaagaucgucaagaagggcgacuccaccaucaugaaguccgagguggaguacggccacugcaacacgaagugccagaccccgaucggggccaucaacucgucgaugcccuuccacaacauccacccccugaccaucggcgagugccccaaguacgucaagagcaacaagcuggugcucgcgaccgggcugcgcaacuccccgcugcgggagaagcgccggaagcgcggccucuucggcgccaucgccggguucaucgagggcggguggcagggcaugguggacgggugguacggcuaccaccacucgaacgagcagggcuccggguacgccgccgacaaggagagcacgcagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggaccuacaacgccgagcugcugguccucauggagaacgagcgcacgcuggacuuccacgacucgaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagucgaucggcaccuaccagauccuguccaucuacagcaccgucgcguccucgcucgcccuggccaucaucguggccgggcugucccucuggaugugcagcaacggcucccugcagugccgcaucugcaucuga

SEQ ID NO: 13026 - RNA, 1689 nt, Artificial Sequence
  derived and/or modified CDS sequence (AUadapt) from InfluenzaA__AIU46714__HA
auggccaucaucuaccugauccuccuguucaccgccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaaccccaaguacucccucugcuacccgggcucguucaacgacuacgaggagcugaagcaccuccuguccagcgugaagcacuucgagaaggugaagauccugcccaaggacggguggacgcagcacaagaccgacggcggguccaaggccugcgccgucucgggcaagcaguccuucuuccgcaacaugguguggcugaccaagaaggggcagaacuaccccguggcgaagcggucguacaacaacaccuccggcgagcagaugcucaucaucuggggcguccaccaccccaacgacgaggaggagcagcgcgcccuguaccagaagguggggacguacgugagcgccuccaccucgacccugaacaagcgguccaccccggagaucgccgcgcgccccgaggucaacggccucgggucgcggauggaguucuccuggacgcugcuggacgugugggacaccaucaacuucgagagcaccggcaaccucguggcccccgaguacggcuucaagaucuccaagcgcgggucgucgggcaucaucaagaccgaggggacgcugggcaacugcgagaccaagugccagacgccccugggggccaucaacaccacccucccguuccacaacguccacccccugaccaucggcgagugccccaaguacgugaaguccgagaagcuggugcucgccaccggccugcggaacgucccccagaucgagucgcgcgggcuguucggcgccaucgcgggguucaucgagggcggguggcagggcaugguggacggcugguacggguaccaccacuccaacgaccagggcagcggguacgccgccgacaaggaguccacccagaaggccuucgaccggaucacgaacaaggugaacucggucaucgagaagaugaacacccaguucgaggccgugggcaaggaguucuccaaccucgagcgccggcuggagaaccugaacaagaagauggaggacggguuccucgacguguggaccuacaacgcggagcugcugguccucauggagaacgagcgcacccuggacuuccacgacucgaacgugaagaaccuguacgacaagguccggaugcagcuccgcgacaacgugaaggagcugggcaacggcugcuucgaguucuaccacaagugcgacaacgagugcaugaacuccgugaagaacgggacguacgacuacccgaaguacgaggaggagagcaagcugaagcggaacgagaucaagggcgucaagcucuccucgauggggguguaccagauccuggccaucuacgccaccguggccggcucccugucgcucgccaucaugaucgcgggcaucuccuucuggaugugcagcaacgggucccugcagugccgcaucugcaucuga

SEQ ID NO: 13027 - RNA, 1701 nt, Artificial Sequence
  derived and/or modified CDS sequence (AUadapt) from InfluenzaA__AIV09219__HA
augaaggccauccuggugguccuccuguacaccuucgccaccacgaacgcggacauccugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagcugcucucgaccaccuccagcugguccuacaucguggagacgucguccagcgacaacgggaccugcuaccccggcgacuucaucgacuacgaggagcugcgggagcagcuguccucgguguccagcuucgagcgcuucgagaucuuccccaagaccuccucguggcccgaccacgacuccaacaagggcgucaccgccgccugcccgcacgccggcgccgggucguucuacaagaaccucaucuggcuggugaagaagggcaacuccuaccccaagcugagcaaguccuacaucaacgacaaggggaaggaggugcucguccuguggggcauccaccacccgcccacgucggccgaccagcagcggcuguaccagaacgcggacgccuacguguucgugggcaccagccgcuacuccaagaaguucaagcccgagaucgccauccggcccaagguccgcgaccaggaggggcggaugaacuacuacuggacccucguggagcccggcgacaagaucaccuucgaggccacggggaaccugguggucccccgcuacgccuucgcgauggagcggaacgccggcucgggcaucaucaccuccgacaccccggugcacgacugcaacaccacgugccagacccccaagggggccaucaacaccagccugcccuuccagaacauccaccccaucaccaucggcaagugcccgaaguacgugaaguccacgaagcuccgccuggccaccgggcugcggaacguccccucgauccagucccgcggccucuucggggccaucgcgggcuucaucgagggcggguggaccggcaugguggacgggugguacggcuaccaccaccagaacgagcaggggucgggcuacgccgccgaccugaaguccacccagaacgccaucgacgagaucacgaacaaggugaacagcgucaucgacaagaugaacacccaguucaccgccgugggcaaggaguucaaccaccuggagaagcggaucgagaaccucaacaagaaggucgacgacggguuccuggacaucuggaccuacaacgcggagcugcucgugcugcuggagaacgagcgcacgcucgacuaccacgacuccaacgugaagaaccuguacgagaagguccggucgcagcugaagaacaacgccaaggagaucggcaacgggugcuucgaguucuaccacaagugcgacaacacgugcauggaguccgugaagaacggcaccuacgacuaccccaaguacagcgaggaggccaagcucaaccgcgaggagaucgacggggugaagcuggaguccacccggaucuaccagauccuggccaucuacucgaccgucgccuccagccucgugcugguggucucccugggcgcgaucucguucuggaugugcagcaacggcucccuccagugccgcaucugcaucuga

SEQ ID NO: 13028 - RNA, 1701 nt, Artificial Sequence
  derived and/or modified CDS sequence (AUadapt) from InfluenzaA__AIW60689__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgucgcuccggucccuggucgccagcuccggcacgcuggaguucaccaacgagggguucaacuggaccggcguggcccaggacgggaccucguacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccucgaucuacgugcaggccuccgggcgcgucaccgugagcacgaagcggucgcagcagaccgugaucccgaacaucggcucccgccccuggguccgggggaucagcucccgcaucucgaucuacuggaccaucgugaagcccggcgacauccugcucaucaacuccaccgggaaccugaucgcgccccggggcuacuucaagauccgcagcggcaaguccucgaucaugcgguccgacgccccgaucgggaacugcaacagcgagugcaucacgcccaacggcuccauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggcuucaucgagaacgggugggagggcaugguggacgggugguacggcuuccgccaccagaacuacgaggggaccggccaggccgccgaccucaagucgacccaggcggccaucaaccagaucaacggcaagcugaaccggcugaucgagaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggacccgcaagcagcugcgcgagaacgccgaggacaugggcaacgggugcuucaagaucuaccacaagugcgacaacgcgugcaucggcucgauccggaacgggacguacgaccacgacgccuaccgcgacgaggcccucaacaaccgguuccagaucaagggcgucgagcugaaguccggcuacaaggacuggauccuguggaucagcuucgccaucuccugcuuccuccugugcgugguccugcucggguucaucaugugggccugccagaagggcaacauccgcugcaacaucugcaucuga

SEQ ID NO: 13029 - RNA, 1701 nt, Artificial Sequence
  derived and/or modified CDS sequence (AUadapt) from InfluenzaA__AIW60690__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgucgcuccggucccuggucgccagcuccggcacgcuggaguucaccaacgagggguucaacuggaccggcguggcccaggacgggaccucguacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccucgcuguacgugcaggccuccgggcgcgucaccgugagcacgaagcggucgcagcagaccgugaucccgaacaucggcucccgccccuggguccgcggggugagcucccggaucucgaucuacuggaccaucgugaagcccggcgacauccuccugaucaacuccaccgggaaccugaucgcgccccggggcuacuucaagauccgcagcggcaaguccucgaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacuacgaggggaccggccaggccgccgaccucaagucgacccaggcggccaucaaccagaucaacggcaagcugaaccggcugaucgagaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcucgauccggaacgggacguacgaccacgacgccuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 13030 - RNA, 1701 nt, Artificial Sequence
  derived and/or modified CDS sequence (AUadapt) from InfluenzaA__AIW60691__HA
augaagaccaucaucgcccugucguacauccucugccugguguucgcccagaagcugcccggcaacgacaacuccaccgcgacgcucugccuggggcaccacgccgucccgaacggcacccuggugaaggccaucaccaacgaccagaucgaggugaccaacgccacggagcucguccagucguccagcaccgggcgcaucugcgacucgccccaccggauccuggacggcaagaacugcacccugaucgacgcccuccugggggacccccacugcgacggcuuccagaacaaggagugggaccuguucguggagcgcagcaaggcguacuccgacugcuaccccuacgacgugccggacuacgccucgcuccggucccuggucgccagcuccggcacccuggaguucacgaacgagggguucaacuggaccggcguggcccaggacgggaccucguacgcgugcaagcgcggcuccgugaaguccuucuucucccggcucaacuggcugcacaagcuggaguacaaguaccccgcccucaacgucaccaugcccaacaacgacaaguucgacaagcuguacaucuggggcgugcaccaccccagcacggacuccgaccagacccgccuguacgugcaggccucggggcgggucaccguguccaccaagcgcagccagcagacggugaucccgaacaucggcucgcggcccuggguccgcgggaucuccagccggaucuccaucuacuggaccaucgugaagcccggcgacauccuccugaucaacucgaccgggaaccugaucgcgccccgcggcuacuucaagauccgguccggcaagagcuccaucaugcgcucggacgccccgaucgggaacugcaacuccgagugcaucacccccaacggcagcauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggcuucaucgagaacgggugggagggcaugguggacgggugguacggcuuccggcaccagaacuccgaggggacgggccaggccgcggaccucaagucgacccaggccgccaucaaccagaucaacggcaagcugaaccgccugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacgggugcuucaagaucuaccacaagugcgacaacgccugcaucggcucgauccgcaacgggaccuacgaccacgacgucuaccgggacgaggcccugaacaaccgcuuccagaucaagggcguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 13031 - RNA, 1701 nt, Artificial Sequence
  derived and/or modified CDS sequence (AUadapt) from InfluenzaA__AIW60692__HA
augaagaccaucaucgcccugucguacauccucugccugguguucgcccagaagcugcccggcaacgacaacuccaccgcgacgcucugccuggggcaccacgccgucccgaacggcacccuggugaaggccaucaccaacgaccagaucgaggugaccaacgccacggagcucguccagagcuccucgaccgggcgcaucugcgacagcccccaccggauccuggacggcaagaacugcacccugaucgacgcccuccugggggacccccacugcgacggcuuccagaacaaggagugggaccuguucguggagcgcucgaaggcguacuccgacugcuaccccuacgacgugccggacuacgccagccuccggucccuggucgccucguccggcacccuggaguucacgaacgagggguucaacuggaccggcguggcccaggacgggaccagcuacgcgugcaagcgcggcuccgugaaguccuucuucucccggcucaacuggcugcacaagcuggaguacaaguaccccgcccucaacgucaccaugcccaacaacgacaaguucgacaagcuguacaucuggggcgugcaccaccccucgacggacuccgaccagaccagccuguacgugcaggccuccgggcgcgucaccgugucgaccaagcggagccagcagacggugaucccgaacaucggcucccgccccuggguccgggggaucucgucccgcaucagcaucuacuggaccaucgugaagcccggcgacauccuccugaucaacuccaccgggaaccugaucgcgccccggggcuacuucaagauccgcucgggcaaguccagcaucaugcgguccgacgccccgaucgggaacugcaacucggagugcaucacccccaacggcuccauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgcggaccugaaguccacccaggccgccaucaaccagaucaacggcaagcucaaccggcugaucgagaagaccaacgagaaguuccaccagaucgagaaggaguucucggaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacgucuaccgcgacgaggcccugaacaaccgguuccagaucaagggcguggagcucaagucgggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 13032 - RNA, 1701 nt, Artificial Sequence
  derived and/or modified CDS sequence (AUadapt) from InfluenzaA__AIW60693__HA
augaagaccaucaucgcccugucguacauccucugccugguguucgcccagaagcugcccggcaacgacaacuccaccgcgacgcucugccuggggcaccacgccguccugaacggcacccucgugaagaccaucaccaacgaccagaucgaggugacgaacgccaccgagcugguccagaacagcuccaccgggcgcaucugcgacucgccgcaccagauccuggacggcgagaacugcacccucaucgacgcccugcugggggacccccacugcgacggcuuccagaacaaggagugggaccucuucguggagcgguccaaggccuacagcaacugcuaccccuacgacgugcccgacuacgcgucccugcgcucgcuggucgccuccagcggcacgcucgaguucaacaacgaguccuucaacuggaccgggguggcccagaacggcaccucguccgccugcaagcggcgcagcaucaaguccuucuucucgcggcugaacuggcugcaccagcucaaguacaaguacccggcgcugaacgugaccaugcccaacaacgagaaguucgacaagcuguacaucuggggcguccaccaccccuccacggacagcgaccagaccuccaucuacgcccaggccucggggcgcgugaccgugagcaccaagcggucccagcagacggucauccccaacaucgggucgcgcccgugggugcggggcguguccagcaucaucuccaucuacuggaccaucgucaagcccggcgacauccuccugaucaacucgaccgggaaccugaucgcgccccgcggcuacuucaagauccgguccggcaagagcuccaucaugcgcucggacgcccccaucgggaagugcaacuccgagugcaucaccccgaacggcagcauccccaacgacaagcccuuccagaacgugaaccggaucacguacggggccugcccccgcuacgugaagcagaacacccucaagcuggccaccggcaugcggaacgucccggagaagcagacccgcgggaucuucggcgccaucgccggguucaucgagaacggcugggagggcaugguggacgggugguacggcuuccggcaccagaacuccgaggggacgggccaggccgcggaccucaagucgacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcacccggaagcagcuccgcgagaacgcggaggacaugggcaacgggugcuucaagaucuaccacaagugcgacaacgccugcaucggcucgauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 13033 - RNA, 1701 nt, Artificial Sequence
  derived and/or modified CDS sequence (AUadapt) from InfluenzaA__AIW60694__HA
augaagaccaucaucgcccugucguacauccucugccugguguucgcccagaagcugcccggcaacgacaacuccaccgcgacgcucugccuggggcaccacgccguccugaacggcacccucgugaagaccaucaccaacgaccagaucgaggugacgaacgccaccgagcugguccagaacucguccaccgggcgcaucugcgacagcccgcaccagauccuggacggcgagaacugcacccucaucgacgcccugcugggggacccccacugcgacggcuuccagaacaaggagugggaccucuucguggagcgguccaaggccuacucgaacugcuaccccuacgacgugcccgacuacgcgucccugcgcagccuggucgccuccucgggcacgcucgaguucaacaacgaguccuucaacuggaccgggguggcccagaacggcaccagcuccgccugcaagcggcgcucgaucaaguccuucuucagccggcugaacuggcugcaccagcucaaguacaaguacccggcgcugaacgugaccaugcccaacaacgagaaguucgacaagcuguacaucuggggcguccaccaccccuccacggacucggaccagaccucccucuacgcccaggccagcgggcgcgugaccgugucgaccaagcggucccagcagacggucauccccaacaucgggagccgcccgugggugcggggcguguccucgcgcaucuccaucuacuggaccaucgucaagcccggcgacauccugcugaucaacagcaccgggaaccucaucgcgccccggggcuacuucaagauccgcuccggcaagucguccaucaugcggagcgacgcccccaucgggaagugcaacuccgagugcaucaccccgaacggcucgauccccaacgacaagcccuuccagaacgugaaccgcaucacguacggggccugcccccgguacgugaagcagaacacccugaagcuggccaccggcaugcgcaacgucccggagaagcagacccgggggaucuucggcgccaucgccggguucaucgagaacggcugggagggcaugguggacgggugguacggcuuccgccaccagaacuccgaggggacgggccaggccgcggaccucaagagcacccaggccgccaucaaccagaucaacgggaagcugaaccggcugaucgagaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagcggacccgcaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcucaaguccggguacaaggacuggauccuguggaucucguucgccaucagcugcuuccugcucugcgugguccugcugggcuucaucaugugggccugccagaagggcaacauccgcugcaacaucugcaucuga

SEQ ID NO: 13034 - RNA, 1701 nt, Artificial Sequence
  derived and/or modified CDS sequence (AUadapt) from InfluenzaA__AIW60695__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccucgaccgggggcaucugcgacagcccccaccagauccuggacggggagaacugcacccugaucgacgcccuccugggcgacccccacugcgacggcuuccagaacaaggagugggaccuguucguggagcgcucgaaggccuacuccaacugcuaccccuacgacgugccggacuacgcgagccuccggucccuggucgccucguccgggacgcuggaguucaacaacgagagcuucaacuggaccggcguggcccagaacgggaccuccucggccugcaagcgccgguccaacaagagcuucuucucccgccucaacuggcugcaccagcugaacuacaaguaccccgcgcucaacgugaccaugcccaacaacgagaaguucgacaagcuguacaucuggggcguccaccaccccucgacggacuccgaccagaucagcaucuacgcccaggccccggggcgggugaccgugucgaccaagcgcucccagcagaccgucauccccaacaucggcagccggcccugggugcgcggcguguccucgaucaucuccaucuacuggacgaucgucaagcccggggacauccugcucaucaacugcaccggcaaccugaucgccccgcggggguacuucaagauccgcagcggcaaguccucgaucaugcgguccgacgccagcaucggcaagugcaacuccgagugcaucacccccaacgggucgauccccaacgacaagcccuuccagaacgugaaccgcaucaccuacggcgcgugcccgcgguacgugaagcagaacacgcugaagcucgccaccgggaugcgcaacguccccgagaagcagacccggggcaucuucggggccaucgccggcuucaucgagaacggcugggaggggaugguggacggcugguacggguuccgccaccagaacuccgagggcaccgggcaggccgcggaccugaaguccacgcaggccgccaucaaccagaucaacggcaagcugaaccggcucaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgcggaggacauggggaacggcugcuucaagaucuaccacaagugcgacaacgccugcaucgggucgauccggaacggcaccuacgaccacgacguguaccgcgacgaggcccucaacaaccgcuuccagaucaagggggucgagcugaaguccggcuacaaggacuggauccuguggaucagcuucgccaucagcugcuuccuccugugcgugguccugcucggcuucaucaugugggccugccagaaggggaacauccggugcaacaucugcaucuga

SEQ ID NO: 13035 - RNA, 1701 nt, Artificial Sequence
  derived and/or modified CDS sequence (AUadapt) from InfluenzaA__AIW60696__HA
augaagaccaucaucgcccugucguacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagucguccagcaccgggggcaucugcgacucgccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgucgcuccggucccuggucgccagcuccgggacgcuggaguucaacaacgagucguucaacuggaccggcguggaccagaacgggaccuccagcgccugcaagcgccgguccaacaagucguucuucucccgccucaacuggcugcaccagcugaaguacaaguaccccgcccucaacguggcgaugcccaacaacgagaaguucgacaagcuguacaucuggggcguccaccaccccagcaccgacuccgaccagaucucgcuguacgcccaggccccggggcgggugacggugagcaccaagcgcucccagcagaccgucauccccaacaucggcucgcggcccugggugcgcggcguguccagccggaucuccaucuacuggaccaucgucaagcccggggacauccuccugaucaacugcacgggcaaccugaucgccccgcgcggguacuucaagauccggucgggcaaguccagcaucaugcgcuccgacgccucgaucggcaagugcaacuccgagugcaucacccccaacgggagcauccccaacgacaagcccuuccagaacgugaaccggaucaccuacggcgcgugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggucguacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucucguucgccaucagcugcuuccugcugugcgugguccuccugggcuucaucaugugggccugccagaaggggaacauccgcugcaacaucugcaucuga

SEQ ID NO: 13036 - RNA, 1701 nt, Artificial Sequence
  derived and/or modified CDS sequence (AUadapt) from InfluenzaA__AIW60697__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgagccugcggucccucgucgccucguccgggacgcuggaguucaacaacgagagcuucgacuggaccggcgugacccagaacgggaccuccucguccugcaagcgccggucgaacaaguccuucuucagccgccugaacuggcucacgcaccugaaguacaaguaccccgcccugaacgugaccaugcccaacaacgagaaguucgacaagcucuacaucuggggcguccaccaccccgacaccgacuccgugcagaucucgcuguacgcccaggcgagcgggcggaucaccguguccacgaagcgcucgcagcagaccgucaucccgaacaucggcucccggccccgcgugcgggacaucucgucccgcaucagcaucuacuggaccaucgugaagcccggcgacauccugcucaucaacuccaccgggaaccugaucgcgccccggggcuacuucaagauccgcucggggaaguccagcaucaugcgguccgacgccccgaucggcaagugcaacucggagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacucggaggggaccggccaggccgccgaccugaaguccacccaggccgcgaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacucggagaugaacaagcuguucgagcggaccaagaagcagcugcgcgagaacgccgaggacauggggaacggcugcuucaagaucuaccacaagugcgacaacgccugcaucggguccauccgcaacggcacguacgaccacgacguguaccgggacgaggcgcucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 13037 - RNA, 1701 nt, Artificial Sequence
  derived and/or modified CDS sequence (AUadapt) from InfluenzaA__AIW60698__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccucgaccgggggcaucugcgacagcccccaccagauccucgacggggagaacugcacccugaucgacgcccugcucggcgacccccagugcgacggcuuccagaacaagaagugggaccuguucguggagcgcucgaaggccuacuccaacugcuaccccuacgacgugccggaccacgcgucgcugcggucccucgucgccagcuccgggacgcuggaguucaacaacgagucguucgacuggaccggcgugacccagaacgggaccuccucggccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacucggaccagaucucccuguacgcgcaggccucgggccggaucaccgugucgacgaagcgcucccagcagaccgugaucccgaacaucggcagccggccccgcguccgggacaucuccucgcgcaucuccaucuacuggaccaucgugaagcccggggacauccugcucaucaacucgaccggcaaccugaucgcgccccggggguacuucaagauccgcuccggcaagagcuccaucaugcggucggacgccccgaucggcaagugcaacuccgagugcaucacgcccaacgggucgauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcucgauccgcaacgggacguacgaccacgacgucuaccgggacgaggcccucaacaaccgcuuccagaucaagggcguggagcugaaguccggcuacaaggacuggauccuguggaucucguucgccaucagcugcuuccuccugugcguggcccugcucggguucaucaugugggccugccagaagggcaacauccggugcaacaucugcaucuga

SEQ ID NO: 13038 - RNA, 1701 nt, Artificial Sequence
  derived and/or modified CDS sequence (AUadapt) from InfluenzaA__AIW60699__HA
augaagaccaucaucgcccugucguacauccucugccugguguucgcccagaagcugcccggcaacgacaacuccaccgcgacgcucugcaucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcagcaaggccuacuccaacugcuaccccuacgacgugccggacuacgcgucgcugcggucccugaucgccagcuccgggacgcucgaguucaacaacgagucguucaacuggaccggcgucacccagaacgggaccuccucggccugcaagcgccgguccaacaacagcuucuucucccgccugaacuggcugacgcaccucaaguucaaguaccccgcccugaacgugaccaugcccaacaacgaggaguucgacaagcuguacaucuggggcgugcaccaccccgucaccgacaacgaccagaucucgcucuacgcgcaggccuccgggaagaucaccgugagcacgaagcggucgcagcagaccgugaucccgaacaucggcucccgcccccggguccgcgacauccccagccggaucuccaucuacuggaccaucgugaagcccggcgacauccugcugaucaagucgaccgggaaccucaucgccccgcgcggcuacuucaagauccgguccgggaaguccuccaucaugcgcucggacgcccccaucggcaagugcaacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgaggagaccaagaagcagcuccgcgagaacgccgaggacauggggaacggcugcuucaagaucuaccacaagugcgacaacgcgugcaucgggucgauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 13039 - RNA, 1701 nt, Artificial Sequence
  derived and/or modified CDS sequence (AUadapt) from InfluenzaA__AIW60700__HA
augaagaccaucaucgcccugucguacauccucugccugguguucgcccagaagcugcccggcaacgacaacuccaccgcgacgcucugcaucgggcaccacgccgucccgaacggcaccaucgugaagaccaucaccaacgaccagaucgaggugacgaacgccaccgagcugguccagucguccagcaccgggggcaucugcgacucgccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgucgcugcggucccugaucgccagcuccgggacgcucgaguucaacaacgagucguucaacuggaccggcgucacccagaacgggaccuccagcgccugcaagcgccgguccaacaacucguucuucucccgccugaacuggcugacgcaccucaaguucaaguaccccgcccugaacgugaccaugcccaacaacgaggaguucgacaagcuguacaucuggggcgugcaccaccccgggaccgacaacgaccagaucucgcucuacgcgcaggccuccggcaagaucaccgucagcacgaagcggucgcagcagaccgugaucccgaacaucggcucccgcccccgggugcgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaacuccgagugcaucacgcccaacgggucgauccccaacgacaagccguuccagaacgugaaccggaucaccuacggcgccugcccccgcuacgugaagcagaacacccugaagcuggcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccucaagucgacccaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacacgaucgaccugaccgacuccgagaugaacaagcuguucgaggagaccaagaagcagcuccgcgagaacgccgaggacaugggcaacgggugcuucaagaucuaccacaagugcgacaacgcgugcaucggcucgauccggaacgggaccuacgaccacgacguguaccgcgacgaggcccugaacaaccgcuuccagaucaagggcgucgagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 13040 - RNA, 1701 nt, Artificial Sequence
  derived and/or modified CDS sequence (AUadapt) from InfluenzaA__AIW60701__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcuccaaggccuacuccaacugcuaccccuacgacgugccggacuacgccagccugcggucccucgucgcgucguccggcacccuggaguucaacaacgagagcuucaacuggaccggggugacccagaacggcacguccucggccugcauccgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucuucccguacgcccaggcgagcgggcggaucacgguguccaccaagcgcucgcagcagaccgugauccccaacaucggcagccggccccgcguccggaacauccccucccgcaucucgaucuacuggaccaucgugaagccgggcgacauccugcugaucaacuccacggggaaccucaucgcgccccggggcuacuucaagauccgcagcgggaaguccucgaucaugcgguccgacgcccccaucggcaagugcaacucggagugcaucacccccaacggcuccaucccgaacgacaagcccuuccagaacgugaaccgcaucaccuacggggccugcccccgguacgucaagcagaacacccugaagcuggccacgggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccucaaguccacccaggccgcgaucgaccagaucaacgggaagcugaaccggcugaucggcaagaccaacgagaaguuccaccagaucgagaaggaguucucggaggucgagggccgcauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgggagaacgccgaggacauggggaacggcugcuucaagaucuaccacaagugcgacaacgccugcaucggguccauccgcaacggcacguacgaccacgacgucuaccgcgacgaggcgcugaacaaccgguuccagaucaaggggguggagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13041 - RNA, 1701 nt, Artificial Sequence
  derived and/or modified CDS sequence (AUadapt) from InfluenzaA__AIW60702__HA
augaagaccaucaucgcccugucguacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagucguccagcaccggggagaucugcgacucgccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccucgcugcggucccucgucgcgagcuccggcacccuggaguucaacaacgagucguucaacuggaccggggugacccagaacggcacguccagcgccugcauccgccgguccaacaacucguucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgagcgggcggaucacgguguccaccaagcgcucgcagcagaccgugaucccgaacaucggcagccggccccgcguccggaacauccccucccgcaucucgaucuacuggaccaucgugaagcccggcgacauccugcucaucaacuccacggggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacucggaggggaucggccaggccgccgaccugaaguccacccaggccgcgaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacucggagaugaacaagcuguucgagaagaccaagaagcagcugcgggagaacgccgaggacauggggaacggcugcuucaagaucuaccacaagugcgacaacgccugcaucggguccauccgcaacggcacguacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 13042 - RNA, 1701 nt, Artificial Sequence; identical to SEQ ID NO: 12786
  derived and/or modified CDS sequence (AUadapt) from InfluenzaA__AIZ07211__HA

SEQ ID NO: 13043 - RNA, 1701 nt, Artificial Sequence
  derived and/or modified CDS sequence (AUadapt) from InfluenzaA__AIZ07212__HA
augaagaccaucauggcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccucgggccggaucaccgugagcaccaagcgcucccagcaggccgugaucccgaacaucggcucgcggccccgcauccggaacauccccucccgcaucagcaucuacuggaccaucgucaagcccggggacauccugcugaucaacuccacgggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugauggacggcugguacggguuccgccaccagaacuccgagggccgggggcaggccgcggaccucaagucgacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggcgugccagaagggcaacauccggugcaacaucugcaucuga

SEQ ID NO: 13044 - RNA, 1683 nt, Artificial Sequence
  derived and/or modified CDS sequence (AUadapt) from InfluenzaA__AJD78175__HA
auggagaccgccucgcugaucaccauccuccugguggucacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugcugcucgggggccgcgaguggucguacaucguggagcggcccuccgccgccaacggccugugcuaccccgggaacgucgagaaccuggaggagcuccgcucgcuguucuccucggcccgguccuaccagcgcauccagaucuucccggacaccaucuggaacgugucguacuccggcaccucgaaggcgugcuccgacucguucuaccgguccaugcgcuggcugacccagaaggacaacaccuaccccauccaggacgcccaguacaccaacaaccaggggaagaacauccucuucauguggggcaucaaccacccgcccacggacaccgcccagaccaaccuguacacccggacggacaccaccaccucgguggccacggaggagaucaaccgcaccuucaagccccugaucgggccccggccccucgucaacggccugaugggccgcaucaacuacuacugguccgugcugaagcccgggcagacccuccggaucaagucgaacggcaaccugaucgcgccgugguacgggcacauccugucgggcgagucccacggccgcauccucaagaccgaccugaagcgggggucgugcacggugcagugccagaccgagaagggcgggcugaacaccacccuccccuuccagaacgucuccaaguacgccuucggcaacugcucgaaguacaucgggaucaagucccugaagcuggccgugggccuccgcaacgugcccucgcgguccucgcgcggccuguucggggccaucgccggcuucaucgagggcgggugguccgggcuggucgcgggcugguacggcuuccagcacucgaacgaccagggggugggcauggccgccgaccgggacuccacgcagaaggccaucgacaagaucaccucgaaggugaacaacaucgucgacaagaugaacaagcaguacgagaucaucgaccacgaguucaacgagguggagacccgccucaacaugaucaacaacaagaucgacgaccagauccaggacaucugggccuacaacgcggagcugcuggugcuccuggagaaccagaagacccuggacgagcacgacgccaacgucaacaaccucuacaacaaggugaagcgggcccugggguccaacgccguggaggacggcaaggggugcuucgagcuguaccacaagugcgacgaccagugcauggagacgauccgcaacggcaccuacaaccggcgcaaguaccaggaggagucgaagcucgagcgccagaagaucgagggcgucaagcuggaguccgaggggaccuacaagauccugaccaucuacucgaccguggccuccucgcucgucaucgcgaugggcuucgccgccuuccuguucugggccauguccaacgggagcugccggugcaacaucugcaucuga

SEQ ID NO: 13045 - RNA, 1683 nt, Artificial Sequence
  derived and/or modified CDS sequence (AUadapt) from InfluenzaA__AJD78187__HA
auggagaccgccucgcugaucaccauccuccugguggucacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccacccgcugauccuggacacgugcaccaucgaggggcucaucuacggcaaccccuccugcgaccugcugcucgggggccgcgaguggucguacaucguggagcggcccuccgccgucaacggccugugcuaccccgggaacguggagaaccuggaggagcuccgcucgcuguucuccucggcccgguccuaccagcgcauccagaucuucccggacaccaucuggaacgugucguacuccggcaccagcaagaccugcuccgacucguucuaccgguccaugcgcuggcugacccagaaggacaacgccuaccccauccaggacgcgcaguacaccaacaaccaggggaagaacauccucuucauguggggcaucaaccacccgcccacggacaccacccagaccaaccuguacacgcggaccgacaccaccacgucggucgccaccgaggagaucaaccgcaccuucaagccccugaucgggccccggccccucgugaacggccugaugggccgcaucaacuacuacugguccgugcugaagcccgggcagacccuccggaucaagucgaacggcaaccugaucgccccgugguacgggcacauccugucgggcgagucccacggccgcauccucaagacggaccugaagcgggggucgugcaccguccagugccagaccgagaagggcgggcugaacaccacgcuccccuuccagaacguguccaaguacgccuucggcaacugcucgaaguacaucgggaucaagucccugaagcuggcggugggccuccgcaacguccccucgcgguccagccgcggccuguucggggccaucgccggcuucaucgagggcgggugguccgggcugguggccggcugguacggcuuccagcacucgaacgaccagggggugggcauggccgcggaccgggacuccacccagaaggccaucgacaagaucaccucgaaggucaacaacaucguggacaagaugaacaagcaguacgagaucaucgaccacgaguucuccgagguggagacccgccucaacaugaucaacaacaagaucgacgaccagauccaggacaucugggccuacaacgccgagcugcugguccuccuggagaaccagaagacgcuggacgagcacgacgccaacgugaacaaccucuacaacaaggugaagcgggcgcuggggucgaacgccgucgaggacggcaaggggugcuucgagcuguaccacaagugcgacgaccagugcauggagaccauccgcaacggcaccuacaaccggcgcaaguaccaggaggaguccaagcucgagcgccagaagaucgagggcgugaagcuggagucggaggggaccuacaagauccugaccaucuacuccacggucgccucgucccucgugaucgccaugggcuucgccgcguuccuguucugggccaugucgaacgggagcugccggugcaacaucugcaucuga

SEQ ID NO: 13046 - RNA, 1683 nt, Artificial Sequence
  derived and/or modified CDS sequence (AUadapt) from InfluenzaA__AJD78199__HA
auggagaccgugagucugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugagccuggaggggcgcgagugguccuacaucguggagcggcccucggccgucaacggccucugcuaccccggcaacguggagaaccuggaggagcugcgcucccucuucucguccgcccggagcuaccagcgcauccagaucuucccggacaccaucuggaacguguccuacgaugggaccucgaccgccugcuccggcucguucuaccgguccaugcgcuggcugacccggaagaacggggacuaccccauccaggacgcgcaguacaccaacaaccagggcaagaacauccuguucaugugggggaucaaccacccgcccacggacaccacccagcgcgaccucuacacccggacggacaccaccaccagcgucgccacggaggagaucaaccgcaucuucaagccccugaucggcccccggccccuggugaacggccucauggggcgcaucgacuacuacugguccgugcugaagcccggccagacccugcggaucaagucggacgggaaccucaucgccccgugguacggccacauccugucgggcgagucccacgggcgcauccugaagaccgaccucaagcggggcucgugcaccguccagugccagacggagaagggcgggcugaauaccacccugcccuuccagaacguguccaaguacgccuucgggaacugcagcaaguacaucggcaucaagucccucaagcuggcggugggccugcgcaacguccccucgcgguccucgcgcggccucuucggggccaucgccggguucaucgagggcgggugguccggccugguggccggcugguacggguuccagcacagcaacgaccagggcguggggauggccgcggaccgggacuccacccagaaggccaucgacaagaucacgucgaaggucaacaacaucguggacaagaugaacaagcaguacgagaucaucgaccacgaguucuccgagguggagacccgccugaacaugaucaacaacaagaucgacgaccagauccaggacaucugggccuacaaugccgagcuccugguccugcucgagaaccagaagacccuggacgagcacgacgccaacgugaacaaccuguacaacaaggugaagcgggcgcucggcucgaacgccgucgaggacgggaagggcugcuucgagcuguaccacaagugcgacgaccagugcauggagaccauccgcaacggcacguacaaccgccggaaguaccaggaggaguccaagcuggagcgccagaagaucgagggggugaagcucgagagcgagggcaccuacaagauccugaccaucuacuccaccgucgccucgucccuggugaucgccaugggguucgccgcguuccucuucugggccaugucgaacggcagcugccggugcaacaucugcaucuga

SEQ ID NO: 13047 - RNA, 1683 nt, Artificial Sequence
  derived and/or modified CDS sequence (AUadapt) from InfluenzaA__AJD78211__HA
auggagaccgugagucugaucaccauccuccuggucgccacgguguccaacgccgacaagaucugcaucggcuaccagucgaccaacuccaccgagaccguggacacgcugaccgagaacaacguccccgugacccacgcgaaggagcuccugcacaccgagcacaacgggaugcugugcgccacgucgcucggccagccgcugauccuggacacgugcaccaucgaggggcucaucuacggcaaccccuccugcgaccugagccuggaggggcgcgagugguccuacaucguggagcggcccucggccgucaacggccucugcuaccccggcaacguggagaaccuggaggagcugcgcucccucuuuucguccgcccggagcuaccagcgcauccagaucuucccggacaccaucuggaacguguccuacgacgggaccucgaccgccugcuccggcucguucuaccgguccaugcgcuggcugacccggaagaacggggacuaccccauccaggacgcgcaguacaccaacaaccagggcaagaacauccuguucaugugggggaucaaccacccgcccacggacaccacccagcgcgaccucuacacccggacggacaccaccaccagcgucgccacggaggagaucaaccgcaucuuuaagccccugaucggcccccggccccuggugaacggccucauggggcgcaucgacuacuacugguccgugcugaagcccggccagacccugcggaucaagucggacgggaaccucaucgccccgugguacggccacauccugucgggcgagucccacgggcgcauccugaagaccgaccucaagcggggcagcugcaccguccagugccagacggagaagggcgggcugaacaccacccugcccuuccagaacguguccaaguacgccuucgggaacugcucgaaguacaucggcaucaagucccucaagcuggcggugggccugcgcaacguccccucgcggucccgccggggccucuucggggccaucgccggguucaucgagggcggguggagcggccugguggccggcugguacggguuucagcacuccaacgaccagggcguggggauggccgcggaccgcgacucgacccagaaggccaucgacaagaucacguccaaggucaacaacaucguggacaagaugaacaagcaguacgagaucaucgaccacgaguucucggagguggagacccggcugaacaugaucaacaacaagaucgacgaccagauccaggacaucugggccuacaacgccgagcuccugguccugcucgagaaccagaagacccuggacgagcacgacgccaacgugaacaaucuguacaacaaggugaagcgcgcgcucggcuccaacgccgucgaggacgggaagggcugcuucgagcuguaccacaagugcgacgaccagugcauggagaccauccgcaacggcacguacaaccggcgcaaguaccaggaggagagcaagcuggagcggcagaagaucgagggggugaagcucgaguccgagggcaccuacaagauccugaccaucuacucgaccgucgccuccucgcuggugaucgccaugggguucgccgcguuccucuucugggccauguccaacggcagcugccgcugcaacaucugcaucuga

SEQ ID NO: 13048 - RNA, 1689 nt, Artificial Sequence
  derived and/or modified CDS sequence (AUadapt) from InfluenzaA__AJI76401__HA
auggccaucaucuaccugauccuccuguucgccaccgugcgcggcgaccagaucugcaucggguaccacgcgaacaacucgaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggucguacaucauggagaaggagaacccccgcuacucccucugcuacccgggcagccugaacgacuacgaggagcugaagcaccuccuguccucggugaagcacuucgagaaggugcggauccugcccaaggaccgcuggacgaaccacaccaccaccgggggcuccaaggccugcgccgucucggggaagcccuccuucuuccggaacaugguguggcucacgaagaagggccccaacuacccgguggcgaaggggagcuacaacaacaccuccggcgagcagaugcugaucaucuggggcguccaccaccccaucgacgaggccgagcagcgcgcccuguaccagaacguggggaccuacgugucggccuccaccucgacgcucuacaagcgguccauccccgagaucgcggcccgccccgaggucaacggccuggggagccggauggaguucuccuggacccugcucgacgugugggacaccaucaacuucgagucgaccggcaaccugguggccccggaguacggcuucaagaucuccaagcgcgggucgagcggcaucaugaagacggaggggacccugggcaacugcgagaccaagugccagacgccccucggggccaucaacaccacccugcccuuccacaacguccacccccugaccaucggcgagugcccgaaguacgugaaguccgagaagcucgugcuggccaccggccugcggaacgucccccagaucgagucgcgcggccucuucggggcgaucgccggguucaucgagggcggguggcagggcaugguggacggcugguacggguaccaccacuccaacgaccagggcucgggguacgccgccgacaaggaguccacgcagaaggccuucgacggcaucaccaacaaggugaacagcgucaucgagaagaugaacacccaguucgaggcgguggggaaggaguucaacaaccuggagaagcggcuggagaaccucaacaagcgcauggaggacggcuuccuggacguguggaccuacaacgccgagcugcucguccugauggagaacgagcggacgcuggacuuccacgacuccaacgugaagaaccucuacgagaagguccgcaugcagcugcgggacaacgugcgcgagcugggcaacgggugcuucgaguucuaccacaagugcgacgacgagugcaugaacucggugaagaacggcaccuacgacuaccccaaguacgaggaggaguccaagcucaagcggaacgagaucaagggggucaagcugucguccaugggcguguaccagauccuggccaucuacgccaccguggccggcagccucucccuggcgaucauggucgccgggaucucguucuggaugugcuccaacggcagccugcagugccgcaucugcaucuga

SEQ ID NO: 13049 - RNA, 1701 nt, Artificial Sequence; identical to SEQ ID NO: 12310
  derived and/or modified CDS sequence (AUadapt) from InfluenzaA__AJI80137__HA

SEQ ID NO: 13050 - RNA, 1701 nt, Artificial Sequence; identical to SEQ ID NO: 12310
  derived and/or modified CDS sequence (AUadapt) from InfluenzaA__AJI80149__HA

SEQ ID NO: 13051 - RNA, 1701 nt, Artificial Sequence; identical to SEQ ID NO: 10285
  derived and/or modified CDS sequence (AUadapt) from InfluenzaA__AJI80161__HA

SEQ ID NO: 13052 - RNA, 1701 nt, Artificial Sequence
  derived and/or modified CDS sequence (AUadapt) from InfluenzaA__AJI80172__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcucccugaucgacgcccugcucggggacccccagugcgacggcuuccagaacaagaagugggaccuguucguggagcggagcaaggccuacuccaacugcuaccccuacgacgugccggacuacgcgucgcugcgcucccucgucgccagcuccggcacccuggaguucaacaacgagucguucaacugggccggggugacccagaacggcacguccagcgccugcauccggggguccaacagcuccuucuucucgcgccugaacuggcucacccaccugaacuucaaguaccccgcgcugaacgugaccaugcccaacaacgagcaguucgacaagcucuacaucuggggcguccaccaccccgggaccgacaaggaccagaucuuccuguacgcccaguccagcggccggaucacggugucgaccaagcgcucccagcaggccgugaucccgaacaucggcagccggccccgcauccggaacauccccucccgcaucucgaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaagucggagugcaucacgcccaacggguccauccccaacgacaagccguuccagaacgugaaccgcaucaccuacggcgcgugcccccgguacgugaagcagagcacccugaagcucgccaccgggaugcgcaacguccccgagaagcagacgcggggcaucuucggggccaucgccggcuucaucgagaacggcugggaggggaugguggacggcugguacggguuccgccaccagaacuccgagggccgggggcaggccgcggaccucaagucgacccaggccgccaucgaccagaucaacggcaagcugaaccgccugaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacaugggcaacgggugcuucaagaucuaccacaagugcgacaacgccugcaucggcucgauccgcaacgggaccuacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 13053 - RNA, 1701 nt, Artificial Sequence
  derived and/or modified CDS sequence (AUadapt) from InfluenzaA__AJI80196__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaaggagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccagcuccgccugcauccgggggucgaacuccagcuucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagucguccggccggaucaccgugagcaccaagcgcagccagcaggccgugaucccgaacaucggcucccggccccgcauccggaacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggagcauccccaacgacaagccguuccagaacaucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggauggucgacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgaguuccucgucgcccuggagaaccagcacaccaucgaccugaccgacucggagaugaacaagcuguucgagaagaccaagaagcagcuccgcgagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcguggagcucaagagcggcuacaaggacuggauccuguggaucuccuucgccaucagcugcuuccugcucugcgucgcccugcugggguucaucaugugggcgugccagaagggcaacauccggugcaacaucugcaucuga

SEQ ID NO: 13054 - RNA, 1701 nt, Artificial Sequence; identical to SEQ ID NO: 12860
  derived and/or modified CDS sequence (AUadapt) from InfluenzaA__AJI80208__HA

SEQ ID NO: 13055 - RNA, 1701 nt, Artificial Sequence; identical to SEQ ID NO: 162
  derived and/or modified CDS sequence (AUadapt) from InfluenzaA__AJI80220__HA

SEQ ID NO: 13056 - RNA, 1701 nt, Artificial Sequence; identical to SEQ ID NO: 13052
  derived and/or modified CDS sequence (AUadapt) from InfluenzaA__AJI80232__HA

SEQ ID NO: 13057 - RNA, 1701 nt, Artificial Sequence; identical to SEQ ID NO: 162
  derived and/or modified CDS sequence (AUadapt) from InfluenzaA__AJI80244__HA

SEQ ID NO: 13058 - RNA, 1701 nt, Artificial Sequence; identical to SEQ ID NO: 10103
  derived and/or modified CDS sequence (AUadapt) from InfluenzaA__AJI80256__HA

SEQ ID NO: 13059 - RNA, 1701 nt, Artificial Sequence; identical to SEQ ID NO: 162
  derived and/or modified CDS sequence (AUadapt) from InfluenzaA__AJI80268__HA

SEQ ID NO: 13060 - RNA, 1701 nt, Artificial Sequence
  derived and/or modified CDS sequence (AUadapt) from InfluenzaA__AJI80280__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucgggaagaucugcgacucgccccaccagauccucgacggcgagaacugcacccugaucgacgcccugcucggggacccccagugcgacggcuuccagaacaaggagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 13061 - RNA, 1701 nt, Artificial Sequence; identical to SEQ ID NO: 12832
  derived and/or modified CDS sequence (AUadapt) from InfluenzaA__AJI80292__HA

SEQ ID NO: 13062 - RNA, 1701 nt, Artificial Sequence; identical to SEQ ID NO: 12860
  derived and/or modified CDS sequence (AUadapt) from InfluenzaA__AJI80303__HA

SEQ ID NO: 13063 - RNA, 1701 nt, Artificial Sequence; identical to SEQ ID NO: 12832
  derived and/or modified CDS sequence (AUadapt) from InfluenzaA__AJI80315__HA

SEQ ID NO: 13064 - RNA, 1701 nt, Artificial Sequence
  derived and/or modified CDS sequence (AUadapt) from InfluenzaA__AJI80326__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcugucccagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucaccauggagaagaacgccgggucgggcaucaucaucuccgacacccccgugcacgacugcaacaccacgugccagaccccggagggcgccaucaacaccagccugcccuuccagaacauccaccccaucaccaucgggaagugccccaaguacgugaaguccacgaagcugcgccucgccaccggccugcggaacgucccgucgauccagucccgcgggcuguucggcgcgaucgccggguucaucgagggcggcuggaccgggaugguggacggcugguacggguaccaccaccagaacgagcagggcagcggguacgccgccgaccucaaguccacccagaacgccaucgacaagaucacgaacaaggugaacucggucaucgagaagaugaacacccaguucaccgcggugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggccaucuacuccaccgucgcgucgucccuggugcucguggucagccugggggccaucucguucuggaugugcuccaacggcagccugcagugccgcaucugcaucuga

SEQ ID NO: 13065 - RNA, 1701 nt, Artificial Sequence
  derived and/or modified CDS sequence (AUadapt) from InfluenzaA__AJI80337__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagauguuccccaagaccagcuccuggcccaaccacgacucgaacaagggggugaccgccgccugcccgcacgccggcgcgaaguccuucuacaagaaccugaucuggcucgucaagaaggggaacagcuaccccaagcuguccaagucguacaucaacgacaagggcaaggaggugcuggugcucugggggauccaccaccccagcaccacggccgaccagcagucccuguaccagaacgccaacgccuacgucuucgugggcaccucgaaguacuccaagaaguucaagcccgagaucgccauccggccgaaggugcgcgaccaggagggccggaugaacuacuacuggacccugaucgagcccggggacaagaucaccuucgaggcgacgggcaaccucgucgugccccgcuacgccuucgccauggagcggaacgccgggucgggcaucaucaucuccgacacccccgugcacgacugcaacacgaccugccagaccccggagggcgccaucaacaccagccugcccuuccagaacauccaccccaucaccaucgggaagugccccaaguacgucaaguccaccaagcugcgccucgcgacgggccugcggaacaucccgucgauccagucccgcgggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaagguccggaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgagaagaucgacggcgugaagcucgagagcacccggaucuaccagauccuggcgaucuacuccaccgucgccucgucccuggugcucguggucagccugggggccaucucguucuggaugugcuccaacggcagccugcagugccgcaucugcaucuga

SEQ ID NO: 13066 - RNA, 1701 nt, Artificial Sequence; identical to SEQ ID NO: 162
  derived and/or modified CDS sequence (AUadapt) from InfluenzaA__AJI80348__HA

SEQ ID NO: 13067 - RNA, 1701 nt, Artificial Sequence; identical to SEQ ID NO: 10103
  derived and/or modified CDS sequence (AUadapt) from InfluenzaA__AJI80360__HA

SEQ ID NO: 13068 - RNA, 1701 nt, Artificial Sequence; identical to SEQ ID NO: 10103
  derived and/or modified CDS sequence (AUadapt) from InfluenzaA__AJI80372__HA

SEQ ID NO: 13069 - RNA, 1701 nt, Artificial Sequence; identical to SEQ ID NO: 10285
  derived and/or modified CDS sequence (AUadapt) from InfluenzaA__AJI80384__HA

SEQ ID NO: 13070 - RNA, 1701 nt, Artificial Sequence; identical to SEQ ID NO: 10285
  derived and/or modified CDS sequence (AUadapt) from InfluenzaA__AJI80395__HA

SEQ ID NO: 13071 - RNA, 1701 nt, Artificial Sequence; identical to SEQ ID NO: 10285
  derived and/or modified CDS sequence (AUadapt) from InfluenzaA__AJI80406__HA

SEQ ID NO: 13072 - RNA, 1701 nt, Artificial Sequence; identical to SEQ ID NO: 10285
  derived and/or modified CDS sequence (AUadapt) from InfluenzaA__AJI80417__HA

SEQ ID NO: 13073 - RNA, 1701 nt, Artificial Sequence; identical to SEQ ID NO: 10285
  derived and/or modified CDS sequence (AUadapt) from InfluenzaA__AJI80428__HA

SEQ ID NO: 13074 - RNA, 1701 nt, Artificial Sequence; identical to SEQ ID NO: 162
  derived and/or modified CDS sequence (AUadapt) from InfluenzaA__AJI80439__HA

SEQ ID NO: 13075 - RNA, 1701 nt, Artificial Sequence; identical to SEQ ID NO: 162
  derived and/or modified CDS sequence (AUadapt) from InfluenzaA__AJI80462__HA

SEQ ID NO: 13076 - RNA, 1701 nt, Artificial Sequence
  derived and/or modified CDS sequence (AUadapt) from InfluenzaA__AJI80474__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccaucaaccugcuggaggacaagcacaacgggaagcucugcaagcugcgcggcguggcgccccugcaccucgggaagugcaacaucgccggcuggauccuggggaacccggagugcgagucgcuguccaccgccagcuccuggucguacaucgucgagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggugaccgccgccugcccgcacgccggcgcgaaguccuucuacaagaaccugaucuggcucgucaagaaggggaacagcuaccccaagcugucccagucguacaucaacgacaagggcaaggaggugcuggugcucugggggauccaccaccccagcaccacggccgaccagcagucccuguaccagaacgccgacgccuacgucuucgugggcaccucgcgguacuccaagaaguucaagcccgagaucgccauccgcccgaaggugcgggaccaggagggccgcaugaacuacuacuggacccuggucgagcccggggacaagaucaccuucgaggcgacgggcaaccucguggugccccgguacgccuucaccauggagcgcaacgccgggucgggcaucaucaucuccgacacccccguccacgacugcaacaccacgugccagaccccggagggcgccaucaacaccagccugcccuuccagaacauccaccccaucaccaucgggaagugccccaaguacgugaaguccacgaagcugcggcucgccaccggccugcgcaacgugccgucgauccagucccgggggcuguucggcgcgaucgccggguucaucgagggcggcuggaccgggauggucgacggcugguacggguaccaccaccagaacgagcagggcagcggguacgccgccgaccucaaguccacccagaacgccaucgacaagaucacgaacaaggugaacucggugaucgagaagaugaacacccaguucaccgcggucggcaaggaguucaaccaccuggagaagcgcaucgagaaccugaacaagaagguggacgacggcuuccucgacaucuggaccuacaacgccgagcugcugguccuccuggagaacgagcggacgcuggacuaccacgacuccaacgugaagaaccucuacgagaaggugcgcaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgggagaagaucgacggcgugaagcucgagagcacccgcaucuaccagauccuggccaucuacuccaccguggcgucgucccugguccucguggugagccugggggccaucucguucuggaugugcuccaacggcagccugcagugccggaucugcaucuga

SEQ ID NO: 13077 - RNA, 1701 nt, Artificial Sequence; identical to SEQ ID NO: 13076
  derived and/or modified CDS sequence (AUadapt) from InfluenzaA__AJI80485__HA

SEQ ID NO: 13078 - RNA, 1701 nt, Artificial Sequence; identical to SEQ ID NO: 10285
  derived and/or modified CDS sequence (AUadapt) from InfluenzaA__AJI80496__HA

SEQ ID NO: 13079 - RNA, 1701 nt, Artificial Sequence; identical to SEQ ID NO: 12888
  derived and/or modified CDS sequence (AUadapt) from InfluenzaA__AJI80507__HA

SEQ ID NO: 13080 - RNA, 1701 nt, Artificial Sequence; identical to SEQ ID NO: 10285
  derived and/or modified CDS sequence (AUadapt) from InfluenzaA__AJI80518__HA

SEQ ID NO: 13081 - RNA, 1701 nt, Artificial Sequence; identical to SEQ ID NO: 8377
  derived and/or modified CDS sequence (AUadapt) from InfluenzaA__AJJ98765__HA

SEQ ID NO: 13082 - RNA, 1701 nt, Artificial Sequence
  derived and/or modified CDS sequence (AUadapt) from InfluenzaA__AJJ98777__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuucuccaccggggagaucugcaacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgccggagcaacaacuccuucuucucgcgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccucgcgcaucuccaucuacuggaccaucgugaagcccggcgacauccugcucaucaacagcaccgggaaccugaucgccccgcggggcuacuucaagauccgcuccggcaagucguccaucaugcggagcgacgcccccaucgggaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 13083 - RNA, 1701 nt, Artificial Sequence; identical to SEQ ID NO: 9698
  derived and/or modified CDS sequence (AUadapt) from InfluenzaA__AJJ98789__HA

SEQ ID NO: 13084 - RNA, 1701 nt, Artificial Sequence
  derived and/or modified CDS sequence (AUadapt) from InfluenzaA__AJJ98801__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgcaacaaggccuacuccaacugcuaccccuacgacgugccggacuacgcgucgcugcggucccucgucgccagcuccggcacccuggaguucaacaacgagucguucaacuggacgggggugacccagaacggcaccuccagcgccugcauccgccgguccaacaacucguucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcggaucaccgugucgaccaagcgcucccagcaggccgugaucccgaacaucggcagccggccccgcauccggaacauccccucgcgcaucuccaucuacuggacgaucgucaagcccggcgacauccugcucaucaacagcaccgggaaccugaucgccccgcggggcuacuucaagauccgcuccggcaagucguccaucaugcggagcgacgcccccaucgggaagugcaaguccgagugcaucacccccaacggcucgauccccaacgacaagccguuccagaacgugaaccgcaucaccuacggggccugcccccgguacgugaagcaguccacgcugaagcucgcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagacgaacgagaaguuccaccagaucgagaaggaguucucggagguggagggccggauccaggaccuggagaaguacgucgaggacaccaagaucgaccugugguccuacaacgccgagcuccugguggcccuggagaaccagcacaccaucgaccucaccgacagcgagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcucaagucgggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 13085 - RNA, 1701 nt, Artificial Sequence
  derived and/or modified CDS sequence (AUadapt) from InfluenzaA__AJJ98813__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccguggucccgaacaucggcucccgcccccggauccgcaacauccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 13086 - RNA, 1701 nt, Artificial Sequence
  derived and/or modified CDS sequence (AUadapt) from InfluenzaA__AJJ98825__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacaacuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgccaccggauccgcaacauccccucccggaucucgaucuacuggacgaucgucaagcccggcgacauccugcucaucaacuccaccgggaaccugaucgcgccccgcggcuacuucaagauccggagcgggaaguccucgaucaugcgcuccgacgccccgaucggcaagugcaagagcgagugcaucacccccaacggcuccauccccaacgacaagcccuuccagaacgugaaccggaucaccuacggggccugcccgcgcuacgugaagcagucgacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 13087 - RNA, 1701 nt, Artificial Sequence
  derived and/or modified CDS sequence (AUadapt) from InfluenzaA__AJJ98837__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagucgacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccugaaguccacgcaggccgccaucgaccagaucaacgggaagcugaaccgccucaucggcaagaccaacgagaaguuccaccagaucgagaaggaguucuccgagguggagggccggauccaggaccuggagaaguacguggaggacaccaagaucgaccuguggagcuacaacgccgagcuccuggucgcgcuggagaaccagcacaccaucgaccucacggacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcgucgcgcugcucggcuucaucaugugggccugccagaaggggaacauccggugcaacaucugcaucuga

SEQ ID NO: 13088 - RNA, 1701 nt, Artificial Sequence
  derived and/or modified CDS sequence (AUadapt) from InfluenzaA__AJJ98849__HA
augaagaccaucaucgcccugucguacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggcugcgcguccggaacauccccucccgcgugagcaucuacuggaccaucgugaagcccggcgacauccuccugaucaacuccaccgggaaccugaucgcgccccggggcuacuucaagauccgcucggggaaguccucgaucaugcgguccgacgccccgaucggcaagugcaacagcgccugcaucacccccaacggcuccauccccaacgacaagcccuuccagaacgucaaccgcaucacguacggggccugcccgcgguacgugaagcagaacacccucaagcuggccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcucaaccgccugaucggcaagaccaacgagaaguuccaccagaucgagaaggaguucagcgagguggagggccggauccaggaccuggagaaguacguggaggacaccaagaucgaccucugguccuacaacgccgagcugcuggucgcgcucgagaaccagcacaccaucgaccugacggacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcugaaguccggcuacaaggacuggauccucuggaucuccuucgccaucagcugcuuccugcugugcgucgcgcuccugggcuucaucaugugggccugccagaaggggaacauccggugcaacaucugcaucuga

SEQ ID NO: 13089 - RNA, 1701 nt, Artificial Sequence
  derived and/or modified CDS sequence (AUadapt) from InfluenzaA__AJJ98861__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucucguccaccggggagaucugcgacagcccccaccagauccucgacggcgagaacugcacccugaucgacgcccugcucggggacccccagugcgacggcuuccagaacaagaagugggaccuguucguggagcgcuccaaggccuacucgaacugcuaccccuacgacgugccggacuacgcgucccugcggagccucgucgccuccucgggcacgcuggaguucaacaacgaguccuucaacuggaccggggugacccagaacggcaccagcuccgccugcauccgccggucgaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugucgacgaagcgcucccagcagaccgugaucccgaacaucggcucgcggccccgcguccggaacauccccagccgcaucuccaucuacuggaccaucgugaagcccggcgacauccugcucaucaacucgaccgggaaccugaucgccccgcggggcuacuucaagauccgcuccggcaagagcuccaucaugaaguccgacgcccccaucgggaagugcaacucggagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 13090 - RNA, 1701 nt, Artificial Sequence
  derived and/or modified CDS sequence (AUadapt) from InfluenzaA__AJJ98873__HA
augaagaccaucaucgcccugucguacucccucugccugguguucgcccagaagcugcccggcaacgacaacucgaccgcgacgcucugccuggggcaccacgccgucccgaacggcaccaucgugaagaccaucaccaacgaccagaucgaggugacgaacgccaccgagcugguccaguccagcuccaccggggagaucugcgacucgccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggucgcucgucgccuccagcggcacgcuggaguucaacaacgaguccuucaacuggaccggggugacccagaacggcaccucguccgccugcauccgcaagucgaacaacuccuucuucagccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcgcaucaccgugucgacgaagcggagccagcagaccgugaucccgaacaucggcucccgcccccggguccgcaacauccccucgcggaucuccaucuacuggaccaucgugaagcccggcgacauccugcucaucaacagcaccgggaaccugaucgccccgcgcggcuacuucaagauccgguccggcaagucguccaucaugcgcucggacgcccccaucgggaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 13091 - RNA, 1701 nt, Artificial Sequence
  derived and/or modified CDS sequence (AUadapt) from InfluenzaA__AJJ98885__HA
augaagaccaucaucgcccugucgaacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaaggagaaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccggaacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 13092 - RNA, 1701 nt, Artificial Sequence
  derived and/or modified CDS sequence (AUadapt) from InfluenzaA__AJJ98897__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccgcuccgggaaguccuccaucaugcggagcgacgcccccaucggcaagugcaacuccgagugcaucacgcccaacggcucgauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagguggaccuguggucguacaacgccgagcuccuggucgcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 13093 - RNA, 1701 nt, Artificial Sequence; identical to SEQ ID NO: 12015
  derived and/or modified CDS sequence (AUadapt) from InfluenzaA__AJJ98909__HA

SEQ ID NO: 13094 - RNA, 1701 nt, Artificial Sequence
  derived and/or modified CDS sequence (AUadapt) from InfluenzaA__AJJ98921__HA
augaagaccaucaucgcccugucguacauccucugccugguguucgcccagaagcugcccggcaaggacaacuccaccgcgacgcucugccuggggcaccacgccgucccgaacggcaccaucgugaagaccaucaccaacgaccagaucgaggugacgaacgccaccgagcugguccagagcuccucgaccggggagaucugcaacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugaagcagaacggcaccuccucggccugcauccgccgguccaacagcuccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccgugucgaccaagcgcucccagcaggccgugaucccgaacaucggcagccggccccgcauccggaacauccccucccgcaucucgaucuacuggacgaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccgcaacggcaccuacaaccacgacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 13095 - RNA, 1701 nt, Artificial Sequence; identical to SEQ ID NO: 9698
  derived and/or modified CDS sequence (AUadapt) from InfluenzaA__AJJ98933__HA

SEQ ID NO: 13096 - RNA, 1701 nt, Artificial Sequence; identical to SEQ ID NO: 7227
  derived and/or modified CDS sequence (AUadapt) from InfluenzaA__AJJ98945__HA

SEQ ID NO: 13097 - RNA, 1701 nt, Artificial Sequence
  derived and/or modified CDS sequence (AUadapt) from InfluenzaA__AJJ98957__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcacucgaaguucaaguaccccgcccugaacgugaccaugcccaacaacgagcaguucgacaagcuguacaucuggggcguccaccaccccgggaccgacaacgaccagaucuuccucuacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcugaucaacucgaccgggaaccucaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 13098 - RNA, 1701 nt, Artificial Sequence; identical to SEQ ID NO: 2679
  derived and/or modified CDS sequence (AUadapt) from InfluenzaA__AJJ98969__HA

SEQ ID NO: 13099 - RNA, 1701 nt, Artificial Sequence
  derived and/or modified CDS sequence (AUadapt) from InfluenzaA__AJJ98981__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccacauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcaacuccucguucuucucccggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcagagcuccgggcgcaucaccgugagcaccaagcggucgcagcaggccgugaucccgaacaucggcucccgcccccggauccgcaacguccccagccggaucuccaucuacuggacgaucgugaagcccggcgacauccugcucaucaacucgaccgggaaccugaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgucaagcaguccacgcugaagcucgcgaccggcaugcggaacgugcccgagaagcagacccgcgggaucuucggcgccaucgccggguucaucgagaacggcugggagggcaugguggacgggugguacggcuuccggcaccagaacucggaggggcgcggccaggccgccgaccugaaguccacccaggcggccaucgaccagaucaacgggaagcugaaccggcucaucggcaagacgaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccggaacggcaccuacgaccacaacgucuaccgcgacgaggcccucaacaaccgguuccagaucaaggggguggagcucaagagcggcuacaaggacuggauccuguggaucuccuucgccaucagcugcuuccugcugugcguggcccugcucggcuucaucaugugggccugccagaaggggaacauccgcugcaacaucugcaucuga

SEQ ID NO: 13100 - RNA, 1701 nt, Artificial Sequence
  derived and/or modified CDS sequence (AUadapt) from InfluenzaA__AJJ98993__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaucggggagaucugcgacaacccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacccuggaguucaacaacgagagcuucaacuggacgggggugacccagaacggcaccuccucggccugcaugcgccgguccaacagcuccuucuucucgcgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcggaucaccguguccaccaagcgcucgcagcaggccgugaucccgaacaucggcagccggccccgcauccggaacauccccucccgcaucucgaucuacuggacgaucgucaagcccggcgacauccugcucaucaacuccaccgggaaccugaucgccccgcggggcuacuucaagauccgcagcgggaaguccucgaucaugcgguccgacgcccccaucggcaagugcaacagcgagugcaucacccccaacggcuccauccccaacgacaagccguuccagaacgugaaccgcaucaccuacggggccugcccccgguacgugaagcagucgacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 13101 - RNA, 1701 nt, Artificial Sequence
  derived and/or modified CDS sequence (AUadapt) from InfluenzaA__AJJ99005__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaucggggugacccagaacggcaccuccucggccugcauccgccgguccaacaacagcuucuucucccgccugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaggccucggggcggaucaccguguccaccaagcgcagccagcaggccgugaucccgaacaucggcucgcggccccgcguccggaacauccccucccgcgugagcaucuacuggacgaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucaccuacggggccugcccccgguacgugaagcagaacacgcugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacccaggccgccaucgaccagaucaacgggaagcugaaccgccucaucggcaagacgaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucaccgacucggagaugaacaagcuguucgagaagacgaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcgcugcucggcuucaucaugugggccugccagaaggggaacauccggugcaacaucugcaucuga

SEQ ID NO: 13102 - RNA, 1701 nt, Artificial Sequence; identical to SEQ ID NO: 3656
  derived and/or modified CDS sequence (AUadapt) from InfluenzaA__AJJ99017__HA

SEQ ID NO: 13103 - RNA, 1701 nt, Artificial Sequence
  derived and/or modified CDS sequence (AUadapt) from InfluenzaA__AJJ99029__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucaucgagcgcagcaaggccuacuccaacugcuaccccuacgacgugccggacuacgcgucgcugcggucccucguggccagcuccggcacgcuggaguucaacaacgagucguucaacuggaccggggucacccagaacggcaccuccagcuccugcauccgccggucgaacaacuccuucuucagccgccugaacuggcucacgcaccugaaguucaaguaccccgcccugaacgugaccaugcccaacaacgagcaguucgacaagcucuacaucuggggcgugcaccaccccgggaccgacaacgaccagaucuuccuguacgcccaggcguccgggcggaucaccgucucgacgaagcgcagccagcagaccgugaucccgaacaucggcucccggccccgcgugcggaacauccccucgcgcaucuccaucuacuggaccaucgucaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgugaagcagaacacccugaagcucgccaccggcaugcgcaacguccccgagaagcagacgcgggggaucuucggcgcgaucgccggguucaucgagaacggcugggagggcaugguggacgggugguacggcuuccgccaccagaacuccgaggggcggggccaggccgccgaccucaagucgacccaggccgcgaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgccugcaucgggucgauccgcaacggcaccuacgaccacaacguguaccgggacgaggcgcucaacaaccgcuuccagaucaagggggucgagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 13104 - RNA, 1701 nt, Artificial Sequence
  derived and/or modified CDS sequence (AUadapt) from InfluenzaA__AJJ99041__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcaagcgcggguccgacaacucguucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccagcggccgcaucaccguguccacgaagcggucgcagcagaccgugauccccaacaucggcagccgcccccggguccgcaacauccccucccggaucucgaucuacuggaccaucgugaagccgggggacauccugcugaucaacuccaccggcaaccucaucgcgccccgcggguacuucaagauccggagcggcaaguccucgaucaugcgcuccgacgcccccaucggcaagugcaacucggggugcaucacgcccaacggcuccaucccgaacgacaagcccuuccagaacgugaaccggaucaccuacggggccugcccccgcuacgucaagcagagcacccugaagcuggccaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagucgacccaggcggccaucaaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagcgcaccaagaagcagcuccgggagaacgccgaggacauggggaacggcugcuucaagaucuaccacaagugcgacaacgcgugcaucgggucgauccgcaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcguggcccugcugggcuucaucaugugggccugccagaaggggaacauccgcugcaacaucugcaucuga

SEQ ID NO: 13105 - RNA, 1701 nt, Artificial Sequence; identical to SEQ ID NO: 10103
  derived and/or modified CDS sequence (AUadapt) from InfluenzaA__AJJ99053__HA

SEQ ID NO: 13106 - RNA, 1701 nt, Artificial Sequence; identical to SEQ ID NO: 10103
  derived and/or modified CDS sequence (AUadapt) from InfluenzaA__AJJ99065__HA

SEQ ID NO: 13107 - RNA, 1701 nt, Artificial Sequence
  derived and/or modified CDS sequence (AUadapt) from InfluenzaA__AJJ99089__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcggaacaaggccuacuccaacugcuaccccuacgacgugccggacuacgcgagccugcgcucccucgucgccucguccggcacccuggaguucaacaacgagagcuucaacuggacgggggugacccagaacggcaccuccucggccugcauccggcgcuccaacagcuccuucuucucgcggcugaacuggcucacccaccugaacuucaaguaccccgcccugaacgugacgaugcccaacaacgagcaguucgacaagcucuacaucuggggcguccaccaccccgggaccgacaaggaccagaucuuccuguacgcgcaguccagcgggcgcaucaccguguccaccaagcggucgcagcaggccgugaucccgaacaucggcagccgcccccggauccgcaacauccccucccggaucucgaucuacuggacgaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcagucgacgcugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 13108 - RNA, 1701 nt, Artificial Sequence; identical to SEQ ID NO: 9793
  derived and/or modified CDS sequence (AUadapt) from InfluenzaA__AJJ99101__HA

SEQ ID NO: 13109 - RNA, 1701 nt, Artificial Sequence; identical to SEQ ID NO: 9698
  derived and/or modified CDS sequence (AUadapt) from InfluenzaA__AJJ99113__HA

SEQ ID NO: 13110 - RNA, 1701 nt, Artificial Sequence
  derived and/or modified CDS sequence (AUadapt) from InfluenzaA__AJJ99125__HA
augaagaccaucaucgcccugucguacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagucguccagcaccggggagaucugcaacucgccccaccagauccuggacggcgagaacugcacccucaucgacgcccugcugggggacccccagugcgacggcuuccagaacaagaagugggaccucuucguggagcgcagcaaggcccacuccaacugcuaccccuacgacgugccggacuacgcgucgcugcggucccuggucgccagcuccggcacgcucgaguucaacaacgagucguucaacuggaccggggugacccagaacggcaccuccucggccugcauccgccgguccagcaacuccuucuucucgcgccugaacuggcugacgcaccucaacuucaaguaccccgcccugaacgugaccaugcccaacaacgagcaguucgacaagcuguacaucuggggcguccaccaccccgggaccgacaaggaccagaucuuccucuacgcgcaggccuccgggcggaucaccgugagcacgaagcgcucgcagcaggccgugaucccgaacaucggcucccggccccgcguccggaacauccccagccgcguguccaucuacuggaccaucgugaagcccggcgacauccugcugaucaacucgaccgggaaccucaucgccccgcggggcuacuucaagauccgcuccgggaaguccuccaucaugcggucggacgcccccaucggcaagugcaacuccgcgugcaucacccccaacggcagcauccccaacgacaagccguuccagaacgucaaccgcaucacguacggggccugcccccgguacgugaagcagaacacccugaagcuggccaccggcaugcgcaacgugcccgagaagcagacccgggggaucuucggcgccaucgccggguucaucgagaacggcugggagggcauggucgacgggugguacggcuuccgccaccagaacuccgaggggcggggccaggcggccgaccucaagucgacgcaggccgccaucgaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgccgagcugcucgucgcgcuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccgcaacggcaccuacgaccacgacguguaccgggacgaggcccugaacaaccgcuuccagaucaaggggguggagcucaaguccggcuacaaggacuggauccuguggaucagcuucgccaucuccugcuuccugcucugcgucgcgcugcugggcuucaucaugugggccugccagaaggggaacauccggugcaacaucugcaucuga

SEQ ID NO: 13111 - RNA, 1701 nt, Artificial Sequence
  derived and/or modified CDS sequence (AUadapt) from InfluenzaA__AJJ99137__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccucggggcggaucaccguguccacgaagcgcagccagcaggccgugaucccgaacaucggcucgcggccccgcguccggaacauccccucccgcgugagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgcgugcaucacccccaacggcuccauccccaacgacaagccguuccagaacgucaaccgcaucacguacggggccugcccccgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacucggaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcgcuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucguguccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcgcugcucggcuucaucaugugggccugccagaagggcaacauccggugcaacaucugcaucuga

SEQ ID NO: 13112 - RNA, 1701 nt, Artificial Sequence
  derived and/or modified CDS sequence (AUadapt) from InfluenzaA__AJJ99149__HA
augaagaccaucaucgcccugucguacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccucgaccggggagaucugcgacagcccccaccagauccuggacggcaagaacugcacccucaucgacgcccugcugggggacccccagugcgacggcuuccagaacaagaagugggaccucuucguggagcgcucgaaggccuacuccaacugcuaccccuacgacaugccggacuacgcgagccugcggucccugguggccucguccggcacgcucgaguucaacaacgagagcuucaacuggaccggggucacccagaacggcaccuccucggccugcauccgccgguccaacagcuccuucuucucgcgccugaacuggcugacgcaccucaacuucaaguaccaggcccugaacgugaccaugcccaacaacgagcaguucgacaagcuguacaucuggggcgugcaccaccccgggaccgacaaggaccagaucuuccucuacgcgcaggccuccgggcggaucaccgucagcacgaagcgcucgcagcagaccgugauccccaacaucggcucccggccgcgcgugcggaacauccccagccgcaucuccaucuacuggaccaucgucaagcccggcgacauccugcugaucaacucgaccgggaaccucaucgcgccccggggcuacuucaagauccaguccgggaaguccuccaucaugcgcagcgacgccccgaucggcaagugcaacuccgagugcaucacgcccaacggcucgauccccaacgacaagcccuuccagaacgugaaccggaucaccuacggggccugcccgcgcuacgugaagcagaacacccugaagcuggccaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13113 - RNA, 1701 nt, Artificial Sequence
  derived and/or modified CDS sequence (AUadapt) from InfluenzaA__AJJ99161__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccucggccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcggaucaccguguccacgaagcgcagccagcagaccgugaucccgaacaucggcucgcggccccgcguccgggacauccccucccgcaucagcaucuacuggaccaucgugaagcccggcgacauccugcucaucaacuccaccgggaaccugaucgccccgcggggcuacuucaagauccgcucggggaaguccucgaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacucggaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacucggagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 13114 - RNA, 1701 nt, Artificial Sequence
  derived and/or modified CDS sequence (AUadapt) from InfluenzaA__AJJ99173__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcaacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccagcuccggcacgcuggaguucaacaacgagucguucaacuggaccggggugacccagaacggcaccuccagcgccugcauccgccgguccaacucguccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugucgacgaagcgcagccagcagaccgugaucccgaacaucggcucccggccccgcguccggaacauccccucgcgcaucuccaucuacuggaccaucgugaagcccggcgacauccugcucaucaacagcaccgggaaccugaucgccccgcggggcuacuucaagauccgcuccgggaaguccuccaucaugcggucggacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuuccgcaucuaccacaagugcgacaacgcgugcaucgggucgauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 13115 - RNA, 1701 nt, Artificial Sequence
  derived and/or modified CDS sequence (AUadapt) from InfluenzaA__AJJ99185__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccggggagaucugcgacucgccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgucgcugcggucccucgucgccucguccggcacgcuggaguucaacaacgagagcuucaacuggaccggggugacccagaacggcaccuccucggccugcauccgcaaguccaacaacagcuucuucucccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccucggggcgcaucaccguguccacgaagcggucgcagcagaccgugaucccgaacaucggcagccgcccccggguccgcaacauccccucccggaucucgaucuacuggaccaucgugaagcccggcgacauccugcucaucaacuccaccgggaaccugaucgccccgcgcggcuacuucaagauccggagcgggaaguccucgaucaugcgcgccgacgcccccaucggcaagugcaacuccgagugcaucacgcccaacggcucgauccccaacgacaagccguuccagaacgugaaccggaucaccuacggggcgugcccccgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacuccgaggggcgcggccaggccgcggaccugaaguccacccaggccgccaucgaccagaucaacgggaagcugaaccggcucaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgcggaggacauggggaacggcugcuucaagaucuaccacaagugcgacaacgccugcaucgggucgauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggcgugccagaaggggaacauccgcugcaacaucugcaucuga

SEQ ID NO: 13116 - RNA, 1701 nt, Artificial Sequence; identical to SEQ ID NO: 9053
  derived and/or modified CDS sequence (AUadapt) from InfluenzaA__AJJ99197__HA

SEQ ID NO: 13117 - RNA, 1701 nt, Artificial Sequence
  derived and/or modified CDS sequence (AUadapt) from InfluenzaA__AJJ99209__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagucguccagcaccgggggcaucugcgacucgccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgucgcugcggucccucgucgccagcuccgggacgcuggaguucaacaacgagucguucaacuggaccggcgugacccagaacgggaccuccagcgccugcaagcgcaaguccgacaacucguucuucucccggcugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcggccgcaucaccguguccacgaagcggucgcagcagaccgugaucccgaacaucggcagccgcccccggguccgcaacauccccucccggaucucgaucuacuggaccaucgugaagcccggggacauccugcucaucaacuccaccggcaaccugaucgccccgcgcggguacuucaagauccggagcggcaaguccucgaucaugcgcuccgacgcccccaucggcaagugcaacagcgagugcaucacgcccaacggguccauccccaacgacaagccguuccagaacgugaaccggaucaccuacggcgccugcccccgcuacgucaagcagucgacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcucgauccgcaacgggaccuacgaccacgacgucuaccgcgacgaggcccucaacaaccgguuccagaucaagggcguggagcugaaguccggcuacaaggacuggauccuguggaucagcuucgccauguccugcuuccuccugugcguggcccugcucggguucaucaugugggccugccagaagggcaacauccgcugcaacaucugcaucuga

SEQ ID NO: 13118 - RNA, 1701 nt, Artificial Sequence
  derived and/or modified CDS sequence (AUadapt) from InfluenzaA__AJJ99221__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccucgaccggggagaucugcgacagcccccaccagauccucgacggcgagaacugcacccugaucgacgcccugcucggggacccccagugcgacggcuuccagaacaagaagugggaccuguucguggagcgcucgaaggccuacuccaacugcuaccccuacgacgugccggacuacgcgagccugcggucccucgucgccucguccggcacgcuggaguucaacaacgagagcuucaacuggaccggggugacccagaacggcaccuccucggccugcauccgccgguccaacagcuccuucuucucgcgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcucgcagcagaccgugaucccgaacaucggcucccggccccgcguccggaacauccccagccgcaucuccaucuacuggaccaucgugaagcccggcgacauccugcucaucaacucgaccgggaaccugaucgccccgcggggcuacuucaagauccaguccgggaaguccuccaucaugcgcagcgacgcccccaucggcaagugcaacuccgagugcaucacgcccaacggcucgauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggucguacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 13119 - RNA, 1701 nt, Artificial Sequence; identical to SEQ ID NO: 2160
  derived and/or modified CDS sequence (AUadapt) from InfluenzaA__AJJ99233__HA

SEQ ID NO: 13120 - RNA, 1701 nt, Artificial Sequence
  derived and/or modified CDS sequence (AUadapt) from InfluenzaA__AJJ99244__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccggcucggacaacggcacgugcuaccccggggacuucaucgacuacgaggagcugcgggagcagcucuccagcguguccucguucgagcgcuucgagaucuuccccaagaccuccucguggcccaaccacgacuccaacaagggcgucaccgccgccugcccgcacgccggggcgaagggcuucuacaagaaccugaucuggcuggugaagaaggggaacagcuaccccaagcucuccaagucguacaucaacgacaagggcaaggaggugcugguccuguggggcauccaccaccccuccaccacggccgaccagcagucgcucuaccagaacgccgacaccuacguguucguggggaccagccgguacuccaagaaguucaagcccgagaucgccauccgcccgaagguccgggaccaggagggccgcaugaacuacuacuggacccugguggagcccggggacaagaucacguucgaggccaccggcaaccugguggucccccgguacgcguucgccauggagcgcaacgccggcucggggaucaucaucuccgacacccccgugcacgacugcaacaccacgugccagaccccgaagggcgccaucaacaccucgcuccccuuccagaacauccaccccaucaccaucgggaagugccccaaguacgugaaguccacgaagcugcggcuggccaccggccuccgcaacgucccgagcauccagucccgggggcuguucggcgcgaucgccggcuucaucgagggcggguggaccgggaugguggacggcugguacggguaccaccaccagaacgagcagggcucgggcuacgccgccgaccugaaguccacccagaacgccaucgacaagaucacgaacaaggugaacucggucaucgagaagaugaacacccaguucaccgcgguggggaaggaguucaaccaccucgagaagcgcaucgagaaccugaacaagaaggucgacgacggcuuccuggacaucuggaccuacaacgccgagcuccuggugcugcucgagaacgagcggacgcuggacuaccacgacuccaacgugaagaaccuguacgagaagguccgcaaccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagucgacccgcaucuaccagauccucgccaucuacuccaccgucgcgucgucccuggugcugguggucagccucggcgccaucuccuucuggaugugcucgaacgggagccugcagugccggaucugcaucuga

SEQ ID NO: 13121 - RNA, 1701 nt, Artificial Sequence
  derived and/or modified CDS sequence (AUadapt) from InfluenzaA__AJJ99255__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaaccacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcgggccggcgcgaaguccuucuacaagaaccugaucuggcucgugaagaaggggaacagcuaccccaagcuguccaagucguacaucaacgacaagggcaaggaggugcuggucaugugggggauccaccaccccagcaccacggccgaccagcagucccucuaccagaacgccgacgccuacguguucgugggcaccucgcgcuacuccaaggaguucaagcccgagaucgccauccggccgaagguccgcgaccaggagggccggaugaacuacuacuggacccugguggagcccggggacaagaucaccuucgaggcgacgggcaaccugcucgugccccgcuacgccuucgccauggagcggaacgccgggucgggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcugcgccucgcgacgggccugcggaacgugccgucgauccagucccgcgggcuguucggcgccaucgccggguucaucgagggcggcuggaccgggauggucgacggcugguacggguaccaccaccagaacgagcagggcagcggguacgccgccgaccucaaguccacccagaacgcgaucgacaagaucaccaacaaggugaacucggugaucgagaagaugaacacgcaguucaccgccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacuccaacgugaagaaccucuacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgucccugguccucguggugagccugggggccaucucguucuggaugugcuccaacggcagccugcagugccgcaucugcaucuga

SEQ ID NO: 13122 - RNA, 1698 nt, Artificial Sequence
  derived and/or modified CDS sequence (AUadapt) from InfluenzaA__AJJ99267__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacgaucaccggggucuccgccucgugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagaaggcccuguaccacaccgagaacgccuacgugucgguggucagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacucggugaucgagaagaugaacacccaguucaccgccgucgggaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacucgaccgucgccagcucccuggugcuccuggugagccugggggccgucuccuucuggaugugcagcaacggcucccuccagugccgggugugcaucuga

SEQ ID NO: 13123 - RNA, 1701 nt, Artificial Sequence; identical to SEQ ID NO: 7295
  derived and/or modified CDS sequence (AUadapt) from InfluenzaA__AJJ99278__HA

SEQ ID NO: 13124 - RNA, 1701 nt, Artificial Sequence; identical to SEQ ID NO: 7298
  derived and/or modified CDS sequence (AUadapt) from InfluenzaA__AJJ99289__HA

SEQ ID NO: 13125 - RNA, 1698 nt, Artificial Sequence
  derived and/or modified CDS sequence (AUadapt) from InfluenzaA__AJJ99301__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagagccucaucuccaaggagucgugguccuacaucguggagaagcccaaccccgagaacgggaccugcuaccccggccacuucgccgacuacgaggagcugcgcgagcagcugagcuccgugagcuccuucgagcgguucgagaucuucccgaaggagucguccuggcccaaccacacggucaccggggugagcgccuccugcagccacaacggcgaguccucguucuaccgcaaccuccuguggcugaccgggaagaacggccucuaccccaaccuguccaagagcuacgccaacaacaaggagaaggaggugcugguccucuggggcgugcaccacccgcccaacaucggcgaccagaaggcccuguaccacaccgagaacgccuacgugagcgucguguccagccacuacucccggaaguucacgcccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugucgcgcggguucggcuccggcaucaucaacagcaacgcccccauggacaagugcgacgcgaagugccagacgccccagggggccaucaacuccagccuccccuuccagaacguccacccggugaccaucggcgagugccccaaguacgugcgguccgccaagcugcgcauggucaccgggcugcggaacauccccucgauccagucccgcggccucuucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccugaacaagaaggucgacgacggcuucaucgacaucuggaccuacaacgccgagcuccuggugcugcucgagaacgagcggacgcuggacuuccacgacuccaacgugaagaaccuguacgagaaggucaagucgcagcucaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagagcaugggcgucuaccagauccucgccaucuacucgaccguggccuccagccuggugcugcucgucucccugggggccaucagcuucuggaugugcuccaacggcagccugcagugccggaucugcaucuga

SEQ ID NO: 13126 - RNA, 1698 nt, Artificial Sequence
  derived and/or modified CDS sequence (AUadapt) from InfluenzaA__AJJ99324__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagaacagcuucuaccgcaaccugcuguggcucaccgggaaguccggccuguaccccaaccugagcaaguccuacgccaacaacaaggagaaggaggugcucguccuguggggcgugcaccacccgcccaacaucgccgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 13127 - RNA, 1701 nt, Artificial Sequence
  derived and/or modified CDS sequence (AUadapt) from InfluenzaA__AJJ99335__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccaacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaacggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 13128 - RNA, 1701 nt, Artificial Sequence; identical to SEQ ID NO: 5030
  derived and/or modified CDS sequence (AUadapt) from InfluenzaA__AJJ99357__HA

SEQ ID NO: 13129 - RNA, 1701 nt, Artificial Sequence; identical to SEQ ID NO: 7069
  derived and/or modified CDS sequence (AUadapt) from InfluenzaA__AJJ99368__HA

SEQ ID NO: 13130 - RNA, 1701 nt, Artificial Sequence; identical to SEQ ID NO: 6680
  derived and/or modified CDS sequence (AUadapt) from InfluenzaA__AJJ99379__HA

SEQ ID NO: 13131 - RNA, 1701 nt, Artificial Sequence
  derived and/or modified CDS sequence (AUadapt) from InfluenzaA__AJJ99390__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacaagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgggaggagaucgacggcgugaagcucgaguccacccgcaucuaccagauccuggcgaucuacagcaccgucgccucgucccuggugcucguggucagccugggggccaucuccuucuggaugugcagcaacggcucccugcagugccggaucugcaucuga

SEQ ID NO: 13132 - RNA, 1701 nt, Artificial Sequence; identical to SEQ ID NO: 5030
  derived and/or modified CDS sequence (AUadapt) from InfluenzaA__AJJ99401__HA

SEQ ID NO: 13133 - RNA, 1698 nt, Artificial Sequence
  derived and/or modified CDS sequence (AUadapt) from InfluenzaA__AJJ99413__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugucgagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgccuccauggacaagugcgacgcgaagugccagacgccccagggcgccaucaacucgucccugcccuuccagaacguccaccccgugaccaucggggagugcccgaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 13134 - RNA, 1698 nt, Artificial Sequence; identical to SEQ ID NO: 3871
  derived and/or modified CDS sequence (AUadapt) from InfluenzaA__AJJ99425__HA

SEQ ID NO: 13135 - RNA, 1698 nt, Artificial Sequence
  derived and/or modified CDS sequence (AUadapt) from InfluenzaA__AJJ99437__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagaacagcuucuaccgcaaccugcuguggcucaccgggaagaacggccuguaccccucccugagcaaguccuacgccaacaacaaggagaaggaggugcucguccuguggggcgugcaccacccgcccaacaucgccgaccagaagacccuguaccacacggagaacgccuacgugucggucgugagcucccacuacagccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacgcagaacgccaucaacggcaucaccaacaaggugaacucggucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacucgaccguggccagcucccuggugcuccuggucagccugggcgccaucuccuucuggaugugcagcaacgggucccuccagugccggaucugcaucuga

SEQ ID NO: 13136 - RNA, 1698 nt, Artificial Sequence
  derived and/or modified CDS sequence (AUadapt) from InfluenzaA__AJJ99449__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccucgugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggggaagugcgacgcgaagugccagacgccccagggcgccaucaacucgucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacucggucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccaaggagagcaagcugaaccgcgagaagaucgacggcgugaagcucgaguccaugggggucuaccagauccuggccaucuacucgaccguggccagcucccuggugcuccuggucagccugggcgccaucuccuucuggaugugcagcaacgggucccuccagugccggaucugcaucuga

SEQ ID NO: 13137 - RNA, 1698 nt, Artificial Sequence; identical to SEQ ID NO: 2733
  derived and/or modified CDS sequence (AUadapt) from InfluenzaA__AJJ99461__HA

SEQ ID NO: 13138 - RNA, 1701 nt, Artificial Sequence
  derived and/or modified CDS sequence (AUadapt) from InfluenzaA__AJJ99483__HA
augaaggccauccugcucgugcugcuguacaccuucgccaccgcgaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucaacuacgaggagcugcgggagcagcugucguccgugucguccuucgagcgcuucgagaucuuccccaagaccagcuccuggcccaaccacgacucgaacaagggggugaccgccgccugcccgcgggccggcgcgaaguccuucuacaagaaccucaucuggcuggucaagaaggggaacagcuaccccaagcuguccaagucguacaucaacgacaagggcaaggaggugcucgugcugugggggauccaccaccccagcaccacggccgaccagcagucccuguaccagaacgccgacgccuacgucuucgugggcaccucgcgcuacuccaagaaguucaagcccgagaucgccauccggccgaaggugcgcgaccaggagggccggaugaacuacuacuggacccucgucgagcccggggacaagaucaccuucgaggcgacgggcaaccugcuggugccccgcuacgccuucgccauggagcggaacgccgggucgggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgucgauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccaacaaggucaacucggugaucgagaagaugaacacgcaguucaccgccgugggcaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgucaagaaccuguacgagaaggugcggaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcuggagagcacccggaucuaccagauccucgcgaucuacuccaccguggccucgucccuggugcuggucgugagccucggggccaucucguucuggaugugcuccaacggcagccugcagugccgcaucugcaucuga

SEQ ID NO: 13139 - RNA, 1701 nt, Artificial Sequence; identical to SEQ ID NO: 7298
  derived and/or modified CDS sequence (AUadapt) from InfluenzaA__AJJ99494__HA

SEQ ID NO: 13140 - RNA, 1701 nt, Artificial Sequence
  derived and/or modified CDS sequence (AUadapt) from InfluenzaA__AJJ99505__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacguccaaguacucgaagaaguucaagcccgagaucgccguccggccgaaggugcgcgaccaggagggccggaugaacuacuacuggacccugguggagcccggggacaagaucaccuucgaggcgaccggcaaccuccuggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcuccgccuggcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaagggcuucaaccaccuggagaagcggaucgagaaccucaacaagaaggucgacgacggguuccuggacaucuggaccuacaacgccgagcugcucgugcugcuggagaacgagcgcacccucgacuaccacgacagcaacgugaagaaccuguacgagaagguccggucccagcugaagaacaacgccaaggagaucggcaacgggugcuucgaguucuaccacaagugcgacaacacgugcauggagucggugaagaacggcaccuacgacuaccccaaguacuccgaggaggccaagcucaaccgcgaggagaucgacggggugaagcuggagagcacccggaucuaccagauccuggcgaucuacuccaccgucgccucgagccucgugcugguggucucccugggcgccaucucguucuggaugugcuccaacggcagccuccagugccgcaucugcaucuga

SEQ ID NO: 13141 - RNA, 1701 nt, Artificial Sequence; identical to SEQ ID NO: 3156
  derived and/or modified CDS sequence (AUadapt) from InfluenzaA__AJJ99516__HA

SEQ ID NO: 13142 - RNA, 1701 nt, Artificial Sequence
  derived and/or modified CDS sequence (AUadapt) from InfluenzaA__AJJ99527__HA
augaaggccauccugcucgugcugcuguacaccuucgccaccgcgaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucaacuacgaggagcugcgggagcagcugucguccgugagcuccuucgagcgcuucgagaucuuccccaagaccucguccuggcccaaccacgacagcaacaagggggugaccgccgccugcccgcgggccggcgcgaaguccuucuacaagaaccucaucuggcuggucaagaaggggaacucguaccccaagcuguccaagagcuacaucaacgacaagggcaaggaggugcucgugcugugggggauccaccaccccucgaccacggccgaccagcagucccuguaccagaacgccgacgccuacgucuucgugggcaccucgcgcuacuccaagaaguucaagcccgagaucgccauccggccgaaggugcgcgaccaggagggccggaugaacuacuacuggacccucgucgagcccggggacaagaucaccuucgaggcgacgggcaaccugcuggugccccgcuacgccuucgccauggagcggaacgccgggagcggcaucaucaucuccgacacccccgugcacgacugcaacacgaccugccagaccccgaagggcgccaucaacaccucgcuccccuuccagaacauccaccccaucaccaucgggaagugccccaaguacgucaaguccaccaagcugcgccuggcgacgggccuccggaacgugccgagcauccagucccgcgggcuguucggcgccaucgccggguucaucgagggcggcuggaccgggaugguggacggcugguacggguaccaccaccagaacgagcagggcucgggguacgccgccgaccugaaguccacccagaacgucaucgacaagaucaccaacaaggugaacagcgugaucgagaagaugaacacgcaguucaccgcggucggcaaggaguucaaccaccucgagaagcggaucgagaaccugaacaagaagguggacgacggcuuccuggacaucuggaccuacaacgccgagcuccugguccugcucgagaacgagcgcacccuggacuaccacgacuccaacgugaagaaccuguacgagaaggugcggaaccagcucaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcuggagagcacccggaucuaccagauccucgccaucuacuccaccguggcgucgucccugguccugguggugagccucggggccaucucguucuggaugugcuccaacggcagccugcagugccgcaucugcaucuga

SEQ ID NO: 13143 - RNA, 1701 nt, Artificial Sequence
  derived and/or modified CDS sequence (AUadapt) from InfluenzaA__AJJ99538__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 13144 - RNA, 1701 nt, Artificial Sequence
  derived and/or modified CDS sequence (AUadapt) from InfluenzaA__AJJ99549__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacacccccgugcacgacugcaacaccacgugccagaccccgaagggggccaucaacaccucccugcccuuccagaacauccaccccaucaccaucggcaagugccccaaguacgucaagucgacgaagcugcggcucgccaccgggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacgcuggacuaccacgacagcaacgugaagaaccucuacgagaagguccgcaaccagcugaagaacaacgccaaggagaucggcaacgggugcuucgaguucuaccacaagugcgacaacaugugcauggaguccgugaagaacggcaccuacgacuaccccaaguacucggaggaggccaagcugaaccgggaggagaucgacggggugaagcucgaguccacccgcaucuaccagauccuggccaucuacucgaccgcggccuccagccugguccucguggugucccugggcgccaucucguucuggaugugcagcaacggcucccugcagugccggaucugcaucuga

SEQ ID NO: 13145 - RNA, 1701 nt, Artificial Sequence; identical to SEQ ID NO: 7334
  derived and/or modified CDS sequence (AUadapt) from InfluenzaA__AJJ99560__HA

SEQ ID NO: 13146 - RNA, 1701 nt, Artificial Sequence
  derived and/or modified CDS sequence (AUadapt) from InfluenzaA__AJJ99571__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacauccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 13147 - RNA, 1701 nt, Artificial Sequence
  derived and/or modified CDS sequence (AUadapt) from InfluenzaA__AJJ99582__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaacggcgccaucaacaccucccugcccuuccagaacauccaccccaucaccaucgggaagugccccaaguacgucaagucgaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacaagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgagccuggugcucguggucucccugggggccaucucguucuggaugugcuccaacggcagccugcagugccggaucugcaucuga

SEQ ID NO: 13148 - RNA, 1701 nt, Artificial Sequence; identical to SEQ ID NO: 3156
  derived and/or modified CDS sequence (AUadapt) from InfluenzaA__AJJ99593__HA

SEQ ID NO: 13149 - RNA, 1701 nt, Artificial Sequence
  derived and/or modified CDS sequence (AUadapt) from InfluenzaA__AJJ99604__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgcggguccgcgaccaggagggccggaugaacuacuacuggacccugguggagcccggggacaagaucaccuucgaggcgaccggcaaccucguggucccccgcuacgccuucgccauggagcgggacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaagaucgacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagucggucaagaacgggaccuacgacuaccccaaguacuccgaggaggccaagcugaaccgcgaggagaucgacggcgugaagcucgagagcacccggaucuaccagauccuggcgaucuacuccaccguggccucgagccugguccucguggugucccugggggccaucucguucuggaugugcuccaacggcagccugcagugccgcaucugcaucuga

SEQ ID NO: 13150 - RNA, 1698 nt, Artificial Sequence
  derived and/or modified CDS sequence (AUadapt) from InfluenzaA__AJJ99616__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagaacucguucuaccgcaaccugcuguggcucaccgggaagaacggccuguaccccaaccuguccaagagcuacgccaacaacaaggagaaggaggugcucguccuguggggcgugcaccacccgcccaacaucgccaaccagaagacccuguaccacacggagaacgccuacguguccgucgugagcucgcacuacucccggaagcucacccccgagaucgccaagcgccccaaggugcgggaccaggagggccgcaucaacuacuacuggacccugcuggagcccggcgacaccaucaucuucgaggcgaacgggaaccucaucgccccgcgguacgccuucgcccugagccgcggcuucggguccggcaucaucaacucgaacgcccccauggacaagugcgacgcgaagugccagacgccccagggcgccaucaacuccagccugcccuuccagaacguccacccggugaccaucggggagugccccaaguacgugcgguccgccaagcuccgcauggucaccggccugcggaacauccccagcauccagucccgcgggcuguucggcgccaucgccggguucaucgagggcggcuggaccgggaugguggacggcugguacggguaccaccaccagaacgagcagggcucgggguacgcggccgaccagaaguccacgcagaacgccaucaacggcaucaccaacaaggugaacagcgucaucgagaagaugaacacccaguucaccgccgugggcaaggaguucaacaagcucgagcggcgcauggagaaccugaacaagaaggucgacgacggguucaucgacaucuggacguacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacucggaggaguccaagcucaaccgcgagaagaucgacggggugaagcuggagagcaugggcgucuaccagauccuggccaucuacuccaccguggccagcucgcucgugcugcuggucucccucggcgccaucagcuucuggaugugcuccaacgggagccugcagugccggaucugcaucuga

SEQ ID NO: 13151 - RNA, 1698 nt, Artificial Sequence; identical to SEQ ID NO: 3871
  derived and/or modified CDS sequence (AUadapt) from InfluenzaA__AJJ99628__HA

SEQ ID NO: 13152 - RNA, 1698 nt, Artificial Sequence
  derived and/or modified CDS sequence (AUadapt) from InfluenzaA__AJJ99640__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucaccgggaagaacggccuguaccccaaccuguccaagucguacgccaacaacaaggagaaggaggugcucguccuguggggcgugcaccacccgcccaacaucgccaaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucucgcgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccucgauccagucccgcgggcuguucggcgccguggccggguucaucgagggcggcuggaccgggaugguggacggcugguacggguaccaccaccagaacgagcagggcagcggguacgcggccgaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacuccaacgucaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccaccguggccucgagccugguccuccuggugucccugggcgccaucagcuucuggaugugcuccaacgggagccuccagugccggaucugcaucuga

SEQ ID NO: 13153 - RNA, 1698 nt, Artificial Sequence; identical to SEQ ID NO: 3871
  derived and/or modified CDS sequence (AUadapt) from InfluenzaA__AJJ99652__HA

SEQ ID NO: 13154 - RNA, 1698 nt, Artificial Sequence
  derived and/or modified CDS sequence (AUadapt) from InfluenzaA__AJJ99664__HA
augaaggccaagcugcucgugcugcugugcaccuucaccgccacguacgcggacaccaucugcaucggcuaccacgccaacaacucgaccgacaccgucgacacggugcucgagaagaacgugaccgucacccacuccgugaaccugcuggagaacagccacaacgggaagcucugccugcugaagggcaucgcgccccuccagcuggggaacugcuccaucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcgucuccagcuucgagcgguucgagaucuucccgaaggaguccucguggcccaaccacacggugaccgggguguccgccagcugcucccacaacggcgagagcuccuucuaccgcaaccugcuguggcucaccgggaagaacggccuguaccccaaccugucgaaguccuacgccaacaacaaggagaaggagguccucgugcuguggggcgugcaccacccgcccaacaucggcgaccagaaggcccuguaccacaccgagaacgccuacgucagcguggugagcucccacuacucgcggaaguucacgcccgagaucgcgaagcgccccaagguccgggaccaggagggccgcaucaacuacuacuggacccuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacgugcacccggugaccaucggcgagugccccaaguacguccggucggccaagcugcgcauggugaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucacgaacaaggucaacagcgugaucgagaagaugaacacccaguucaccgccguggggaaggaguucaacaagcuggagcggcgcauggagaaccucaacaagaaggucgacgacggcuucaucgacaucuggaccuacaacgcggagcugcuggugcuccuggagaacgagcggacgcuggacuuccacgacucgaacgucaagaaccucuacgagaaggugaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacucgaccguggccagcucccugguccuccuggugagccugggggccaucuccuucuggaugugcagcaacggcucccuccagugccggaucugcaucuga

SEQ ID NO: 13155 - RNA, 1701 nt, Artificial Sequence
  derived and/or modified CDS sequence (AUadapt) from InfluenzaA__AJJ99675__HA
augaaggccauccugcucgugcugcuguacaccuucgccaccgcgaaggccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucaacuacgaggagcugcgggagcagcugucguccgugucguccuucgagcgcuucgagaucuuccccaagaccagcuccuggcccaaccacgacucgaacaagggggugaccgccgccugcccgcgggccggcgcgaaguccuucuacaagaaccucaucuggcuggucaagaaggggaacagcuaccccaagcuguccaagucguacaucaacgacaagggcaaggaggugcucgugcugugggggauccaccaccccagcaccacggccgaccagcagucccuguaccagaacgccgacgccuacgucuucgugggcaccucgcgcuacuccaagaaguucaagcccgagaucgccauccggccgaaggugcgcgaccaggagggccggaugaacuacuacuggacccucgucgagcccggggacaagaucaccuucgaggcgacgggcaaccugcuggugccccgcuacgccuucgccauggagcggaacgccgggucgggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgucgauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucaccgacaaggucaacucggugaucgagaagaugaacacgcaguucaccgccgugggcaaggaguucaaccaccucgagaagcggaucgagaaccugaacaagaaggucgacgacggcuuccuggacaucuggaccuacaacgccgagcuccuggugcugcucgagaacgagcgcacccuggacuaccacgacuccaacgucaagaaccuguacgagaaggugcggaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcuggagagcacccggaucuaccagauccucgcgaucuacuccaccguggccucgucccuggugcuggucgugagccucggggccaucucguucuggaugugcuccaacggcagccugcagugccgcaucugcaucuga

SEQ ID NO: 13156 - RNA, 1701 nt, Artificial Sequence
  derived and/or modified CDS sequence (AUadapt) from InfluenzaA__AJJ99686__HA
augaccgccauccugcucgugcugcuguacaccuucgccacggcgaacgccgacacccucugcaucggcuaccacgccaacaacucgaccgacaccgucgacacggugcuggagaagaacgugaccgucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagacguccagcuccgacaacgggaccugcuaccccggcgacuucaucaacuacgaggagcugcgggagcagcugucguccgugucguccuucgagcgcuucgagaucuuccccaagaccagcuccuggcccaaccacgacucgaacaagggcgugaccgccgccugcccgcgggccggcgcgaaguccuucuacaagaaccucaucuggcuggucaagaaggggaacagcuaccccaagcuguccaagucguacaucaacgacaagggcaaggaggugcucgugcugugggggauccaccaccccagcacgaccgccgaccagcagucccuguaccagaacgccgacgccuacgucuucgugggcaccucgcgcuacuccaagaaguucaagcccgagaucgccauccggccgaaggugcgcgaccaggagggccggaugaacuacuacuggacccucgucgagcccggggacaagaucacguucgaggcgaccggcaaccugcuggugccccgcuacgccuucgccauggagcggaacgccgggucgggcaucaucaucuccgacacccccgugcacgacugcaacaccacgugccagaccccgaagggcgccaucaacaccagccuccccuuccagaacauccaccccaucaccaucgggaagugccccaaguacgucaaguccacgaagcugcgccuggcgaccggccuccggaacgugccgucgauccagucccgcgggcuguucggcgccaucgccggguucaucgagggcggcuggaccgggaugguggacggcugguacggguaccaccaccagaacgagcagggcagcggguacgccgccgaccugaaguccacccagaacgcgaucgacaagaucacgaacaaggucaacucggugaucgagaagaugaacacccaguucaccgccgugggcaaggaguucaaccaccucgagaagcggaucgagaaccugaacaagaaggucgacgacggcuuccuggacaucuggaccuacaacgccgagcuccuggugcugcucgagaacgagcgcacgcuggacuaccacgacuccaacgucaagaaccuguacgagaaggugcggaaccagcucaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgucaagcuggagagcacccggaucuaccagauccucgcgaucuacuccaccguggccucgucccuggugcuggucgugagccucggggccaucucguucuggaugugcuccaacggcagccugcagugccgcaucugcaucuga

SEQ ID NO: 13157 - RNA, 1701 nt, Artificial Sequence
  derived and/or modified CDS sequence (AUadapt) from InfluenzaA__AJJ99697__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgugauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacucggugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaccgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggccucgucccuggugcucgucgugagccugggggcgaucucguucuggaugugcuccaacggcagccugcagugccggaucugcaucuga

SEQ ID NO: 13158 - RNA, 1701 nt, Artificial Sequence
  derived and/or modified CDS sequence (AUadapt) from InfluenzaA__AJJ99708__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccgaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgugauggagcgcaacgccgggucgggcaucaucaucuccgacacccccgugcacgacugcaacaccacgugccagaccccgaagggcgccaucaacaccagccugcccuuccagaacauccaccccaucaccaucgggaagugccccaaguacgucaaguccacgaagcugcggcucgccaccggccugcgcaacgugccgucgauccagucccgggggcuguucggcgccaucgcgggguucaucgagggcggcuggaccgggaugguggacggcugguacggguaccaccaccagaacgagcagggcagcggguacgccgccgaccucaaguccacccagaacgccaucgacaagaucacgaacaaggucaacucggugaucgagaagaugaacacccaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacgcuggacuaccacgacuccaacgucaagaaccucuacgagaaggugcgcaaccagcugaagaacaacgccaaggagaccgggaacggcugcuucgaguucuaccacaagugcgacaacacgugcauggagucggugaagaacgggaccuacgacuaccccaaguacuccgaggaggccaagcugaaccgggagaagaucgacggcgucaagcucgagagcacccgcaucuaccagauccuggccaucuacuccaccguggccucgucccuggugcucgucgugagccugggggcgaucucguucuggaugugcuccaacggcagccugcagugccggaucugcaucuga

SEQ ID NO: 13159 - RNA, 1701 nt, Artificial Sequence
  derived and/or modified CDS sequence (AUadapt) from InfluenzaA__AJJ99719__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccagcaccacggccgaccagcagucgcucuaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccugguggucccccgguacgcguucgccauggagcgcaacgccggcuccggcaucaucaucucggacacccccgugcacgacugcaacaccacgugccagaccccgaagggggccaucaacaccucccuccccuuccagaacauccaccccaucaccaucggcaagugccccaaguacgucaagucgacgaagcugcggcuggccaccgggcuccgcaacgugccguccauccagagccggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgucaucgagaagaugaacacccaguucaccgcggugggcaaggaguucaaccaccuggagaagcgcaucgagaaccugaacaagaaggucgacgacggguuccuggacaucuggaccuacaacgccgagcuccuggugcugcucgagaacgagcggacgcuggacuaccacgacagcaacgugaagaaccuguacgagaagguccgcaaccagcucaagaacaacgccaaggagaucggcaacgggugcuucgaguucuaccacaagugcgacaacacgugcauggaguccgugaagaacggcaccuacgacuaccccaaguacucggaggaggccaagcugaaccgggaggagaucgagggggugaagcuggaguccacccgcaucuaccagauccucgccaucuacucgaccgucgcguccagccuggugcugguggucucccucggcgccaucucguucuggaugugcagcaacggcucccugcagugccggaucugcaucuga

SEQ ID NO: 13160 - RNA, 1701 nt, Artificial Sequence
  derived and/or modified CDS sequence (AUadapt) from InfluenzaA__AJJ99730__HA
augaaggccauccugguggucaugcucuacaccuucgccaccgcgaacgccgacacgcugugcaucggcuaccacgccaacaacucgaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagucgcuguccaccgccagcuccuggucguacaucguggagaccuccucguccgacaacggcacgugcuaccccggcgacuucaucgacuacgaggagcugcgggagcagcucagcuccgugucguccuucgagcgcuucgagaucuuccccaagaccucguccuggcccaaccacgacagcaacaagggggucaccgccgccugcccgcacgccggcgcgaagggguucuacaagaaccugaucuggcuggugaagaagggcaacuccuaccccaagcucucgaaguccuacaucaacgacaaggggaaggaggugcugguccuguggggcauccaccaccccucgaccacggccgaccagcagagccucuaccagaacgccgacaccuacguguucgugggcaccucccgguacucgaagaaguucaagcccgagaucgccauccgcccgaagguccgggaccaggaggggcgcaugaacuacuacuggacccugaucgagcccggcgacaagaucacguucgaggccaccgggaaccugguggugccccgguacgcguucgccauggagcgcaacgccggcuccggcaucaucaucucggacacccccguccacgacugcaacaccacgugccagaccccgaagggggccaucaacaccucccuccccuuccagaacauccaccccaucaccaucggcaagugccccaaguacgucaagagcacgaagcugcggcuggccaccgggcuccgcaacgugccguccauccagucgcggggccuguucggggcgaucgccggcuucaucgagggcggguggaccggcaugguggacgggugguacggcuaccaccaccagaacgagcagggguccggcuacgccgccgaccucaagucgacccagaacgccaucgacaagaucacgaacaaggugaacuccgugaucgagaagaugaacacccaguucaccgcggucggcaaggaguucaaccaccuggagaagcgcaucgagaaccugaacaagaagguggacgacggguuccuggacaucuggaccuacaacgccgagcuccugguccugcucgagaacgagcggacgcuggacuaccacgacagcaacgugaagaaccuguacgagaaggugcgcaaccagcucaagaacaacgccaaggagaucggcaacgggugcuucgaguuccaccacaagugcgacaacacgugcauggaguccgucaagaacggcaccuacgacuaccccaaguacucggaggaggccaagcugaaccgggaggagaucgacggggugaagcuggaguccacccgcaucuaccagauccucgccaucuacucgaccguggcguccagccugguccugguggugucccucggcgccaucucguucuggaugugcagcaacggcucccugcagugccggaucugcaucuga

SEQ ID NO: 13161 - RNA, 1701 nt, Artificial Sequence; identical to SEQ ID NO: 7287
  derived and/or modified CDS sequence (AUadapt) from InfluenzaA__AJJ99741__HA

SEQ ID NO: 13162 - RNA, 1701 nt, Artificial Sequence; identical to SEQ ID NO: 4078
  derived and/or modified CDS sequence (AUadapt) from InfluenzaA__AJJ99752__HA

SEQ ID NO: 13163 - RNA, 1701 nt, Artificial Sequence; identical to SEQ ID NO: 116
  derived and/or modified CDS sequence (AUadapt) from InfluenzaA__AJJ99763__HA

SEQ ID NO: 13164 - RNA, 1698 nt, Artificial Sequence
  derived and/or modified CDS sequence (AUadapt) from InfluenzaA__AJJ99775__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucucgaaggaguccuggagcuacaucguggagaagcccaaccccgagaacgggaccugcuaccccggccacuucgccgacuacgaggagcugcgcgagcagcucuccagcguguccucguucgagcgguucgagaucuucccgaaggaguccagcuggcccaaccacacggucaccgggguguccgccagcugcucccacaacggcgagaacucguucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcucgcacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacucgaacgcccccacggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcucgggguacgcggccgaccagaaguccacccagaacgccaucaacggcaucaccaacaaggugaacagcgucaucgagaagaugaacacccaguucacggccgugggcaaggaguucaacaagcuggagcggcgcauggagaaccucaacaagaaggucgacgacggguucaucgacaucuggaccuacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacucggaggaguccaagcugaaccgcgagaagaucgacggggugaagcucgagagcaugggcgucuaccagauccuggccaucuacuccacgguggccagcucgcuggugcuccuggucucccugggcgccaucagcuucuggaugugcuccaacgggagccuccagugccggaucugcaucuga

SEQ ID NO: 13165 - RNA, 1701 nt, Artificial Sequence
  derived and/or modified CDS sequence (AUadapt) from InfluenzaA__AJJ99786__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgguacucgaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcgacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgugaucgagaagaugaacacccaguucacggccgucggcaaggaguucaaccaccuggagaagcgcaucgagaaccugaacaagaagaucgacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgucaagcucgagagcacccgcaucuaccagauccuggcgaucuacuccgccguggccucgagccuggugcucgucgugucccugggggccaucucguucuggaugugcuccaacggcagccugcagugccggaucugcaucuga

SEQ ID NO: 13166 - RNA, 1698 nt, Artificial Sequence
  derived and/or modified CDS sequence (AUadapt) from InfluenzaA__AJJ99798__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagcgccccaaccccgagaacgggaccugcuaccccggccacuucgccgacuacgaggagcugcgggagcagcucuccagcguguccagcuucgagcgcuucgagaucuucccgaaggaguccucguggcccaaccacacggucaccgggguguccgccagcugcucccacaacggcgagaacagcuucuaccggaaccugcuguggcucaccgggaagaacggccuguaccccaaccuguccaagucguacgccaacaacaaggagaaggaggugcucguccuguggggcgugcaccacccgcccaacaucgccaaccagaagacccuguaccacacggagaacgccuacguguccgucgugagcagccacuacucccgcaaguucacccccgagaucgccaagcggcccaaggugcgcgaccaggagggccggaucaacuacuacuggacccuccuggagcccggcgacaccaucauguucgaggcgaacgggaaccugaucgccccgcgcuacgccuucgcccucucgcggggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgcuccgccaagcugcggauggucaccggccuccgcaacauccccucgauccagucccgggggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacuccaacgugaagaaccucuacgagaaggucaagucgcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgggagaagaucgacggggugaagcucgagagcaugggcgucuaccagauccuggccaucuacuccaccguggccucgagccuggugcuccuggucucccugggcgccaucagcuucuggaugugcuccaacgggagccuccagugccgcaucugcaucuga

SEQ ID NO: 13167 - RNA, 1698 nt, Artificial Sequence; identical to SEQ ID NO: 2733
  derived and/or modified CDS sequence (AUadapt) from InfluenzaA__AJJ99810__HA

SEQ ID NO: 13168 - RNA, 1698 nt, Artificial Sequence
  derived and/or modified CDS sequence (AUadapt) from InfluenzaA__AJJ99822__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacggucaccgggguguccgccagcugcucccacaacggcgagucguccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuucauccagucccgcggccuguucggggccaucgccggcuucaucgagggcggguggaccggcaugguggacgggugguacggcuaccaccaccagaacgagcaggggucgggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagucgaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 13169 - RNA, 1701 nt, Artificial Sequence
  derived and/or modified CDS sequence (AUadapt) from InfluenzaA__AJJ99833__HA
augaaggccauccugcucgugcugcuguacaccuucgccaccgcgaacgccgacacgcucugcaucggcuaccacgccaacaacucgaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagucgcucuccaccgccagcuccuggucguacaucgucgagaccuccagcuccgacaacggcacgugcuaccccggcgacuucaucaacuacgaggagcugcgggagcagcugucguccgugagcuccuucgagcgcuucgagaucuuccccaagaccucguccuggcccaaccacgacagcaacaagggggugaccgccgccugcccgcgggccggcgcgaaguccuucuacaagaaccucaucuggcuggucaagaaggggaacucguaccugaagcucuccaagagcuacaucaacgacaagggcaaggaggugcuggugcugugggggauccaccaccccucgaccacggccgaccagcagucccucuaccagaacgccgacgccuacgucuucgugggcaccucgcgcuacuccaagaaguucaagcccgagaucgccauccggcccaaggugcgcgaccaggagggccggaugaacuacuacuggacccuggucgagccgggggacaagaucaccuucgaggcgacgggcaaccugcucgugccccgcuacgccuucgccauggagcggaacgccgggagcggcaucaucaucuccgacacccccgugcacgacugcaacacgaccugccagacccccaagggcgccaucaacaccucgcugccguuccagaacauccaccccaucaccaucgggaagugccccaaguacgucaaguccaccaagcugcgccucgcgacgggccugcggaacgugcccagcauccagucccgcgggcuguucggcgccaucgccggguucaucgagggcggcuggaccgggaugguggacggcugguacggguaccaccaccagaacgagcagggcucgggguacgccgccgaccucaaguccacccagaacgcgaucgacaagaucaccaacaaggucaacagcgugaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgucaagaaccucuacgagaaggugcggaaccagcugaagaacaacgccaaggagaucgggaacggcugcuucgaguucuaccacaagugcgacaacacgugcauggagucggugaagaacgggaccuacgacuacccgaaguacuccgaggaggccaagcugaaccgcgaggagaucgacggcgucaagcucgagagcacccggaucuaccagauccuggcgaucuacuccaccguggccucgucccuggugcucgucgugagccugggggccaucucguucuggaugugcuccaacggcagccugcagugccgcaucugcaucuga

SEQ ID NO: 13170 - RNA, 1701 nt, Artificial Sequence; identical to SEQ ID NO: 7069
  derived and/or modified CDS sequence (AUadapt) from InfluenzaA__AJJ99844__HA

SEQ ID NO: 13171 - RNA, 1701 nt, Artificial Sequence
  derived and/or modified CDS sequence (AUadapt) from InfluenzaA__AJJ99855__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacagcgucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaucgggaacggcugcuucgaguucuaccacaagugcgacucgacgugcauggaguccgugaagaacgggaccuacgacuaccccaaguacagcgaggaggccaagcugaaccgggaggagaucgacggcgugaagcucgaguccacccgcaucuaccagauccuggccaucuacucgaccgucgcguccagccuggugcucguggucucgcugggggccaucuccuucuggaugugcagcaacggcucccugcagugccggaucugcaucuga

SEQ ID NO: 13172 - RNA, 1701 nt, Artificial Sequence
  derived and/or modified CDS sequence (AUadapt) from InfluenzaA__AJJ99866__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugaagggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacagcaacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccuccgccgaccagcagagccuguaccagaacgccgacgccuacguguucgugggcacgucccgcuacucgaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagucgaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 13173 - RNA, 1701 nt, Artificial Sequence
  derived and/or modified CDS sequence (AUadapt) from InfluenzaA__AJJ99877__HA
auggaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccucguccuggagcuacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacucggucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugcgcaaccucuacgagaagguccggagccagcugaagaacaacgccaaggagaucgggaacggcugcuucgaguucuaccacaagugcgacaacacgugcauggaguccgugaagaacgggaccuacgacuaccccaaguacucggaggaggccaagcugaaccgcgaggagaucgacggcgugaagcucgaguccacccggaucuaccagauccuggcgaucuacagcaccgucgccucgucccuggugcucguggucagccugggggccaucuccuucuggaugugcagcaacggcucccugcagugccgcaucugcaucuga

SEQ ID NO: 13174 - RNA, 1701 nt, Artificial Sequence
  derived and/or modified CDS sequence (AUadapt) from InfluenzaA__AJJ99888__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccucggccgaccagcagucccuguaccagaacgccgacgccuacguguucgugggcacgucgcgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcgacgccggcagcggcaucaucaucuccgacacgcccgugcacgacugcaacacgaccugccagaccccgaagggggccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaagaucgacgacggguuccucgacaucuggaccuacaacgccgagcugcugguccuccuggagaacgagcggacccuggacuaccacgacuccaacgugaagaaccucuacgagaaggugcgcucgcagcugaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcucgaguccacccgcaucuaccagauccuggcgaucuacucgaccguggccuccagccugguccucguggugucgcugggcgccaucuccuucuggaugugcagcaacggcucccugcagugccggaucugcaucuga

SEQ ID NO: 13175 - RNA, 1701 nt, Artificial Sequence
  derived and/or modified CDS sequence (AUadapt) from InfluenzaA__AJJ99899__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcgggccggcgcgaaguccuucuacaagaaccugaucuggcucgugaagaaggggaacagcuaccccaaccuguccaagucguacaucaacgacaagggcaaggaggugcugguccucugggggauccaccaccccagcaccacggccgaccagcagucccuguaccagaacgccgacgccuacguguucgugggcaccucgcgcuacuccaagaaguucaagcccgagaucgccauccggccgaagguccgcgaccaggagggccggaugaacuacuacuggacccugcucgagcccggggacaagaucaccuucgaggcgacgggcaaccugcuggugccccgcuacgccuucgccauggagcggaacgccgggucgggcaucaucaucuccgacacccccgugcacgacugcaacacgaccugccagaccccgaagggcgccaucaacaccagccuccccuuccagaacauccaccccaucaccaucgggaagugccccaaguacgucaaguccaccaagcugcgccuggcgacgggccuccggaacgugccgucgauccagucccgcgggcuguucggcgccaucgccggguucaucgagggcggcuggaccgggaugguggacggcugguacggguaccaccaccagaacggccaggggagcggcuacgccgccgaccugaaguccacccagaacgcggucgacaagaucaccaacaaggugaacucggugaucgagaagaugaacacgcaguucaccgccgucggcaaggaguucaaccaccucgagaagcggaucgagaaccugaacaagaagguggacgacggguuccuggacaucuggaccuacaacgccgagcuccugguccugcucgagaacgagcgcacccuggacuaccacgacuccaacgugaagaaccuguacgagaaggugcggaaccagcucaagaacaacgccaaggagaucggcaacgggugcuucgaguucuaccacaagugcgacaacacgugcauggagucggucaagaacggcaccuacgacuaccccaaguacuccgaggaggccaagcugaaccgcgaggagaucgacggggugaagcuggagagcacccggaucuaccagauccucgcgaucuacuccaccguggccucgucccugguccugguggugagccucggcgccaucucguucuggaugugcuccaacggcagccugcagugccgcaucugcaucuga

SEQ ID NO: 13176 - RNA, 1701 nt, Artificial Sequence
  derived and/or modified CDS sequence (AUadapt) from InfluenzaA__AJJ99910__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucggacaagggggucaccgccgccugcccgcacgccggcgcgaaguccuucuacaagaaccugaucuggcucgugaagaaggggaacucguaccccaagcuguccaagagcuacaucaacgacaagggcaaggaggugcugguccucugggggauccaccaccccucgaccacggccgaccagcagucccuguaccagaacgccgacaccuacguguucgugggcaccucgcgguacuccaagaaguucaagcccgagaucgccauccgcccgaagguccgggaccaggagggccgcaugaacuacuacuggacccugguggagcccggggacaagaucacguucgaggccaccggcaaccucguggucccccgguacgcguucgccauggagcgcaacgccgggagcggcaucaucaucuccgacacccccgugcacgacugcaacaccacgugccagaccccgaagggcgccaucaacaccucgcugcccuuccagaacauccaccccaucaccaucgggaagugccccaaguacgugaaguccacgaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcucgggguacgccgccgaccucaaguccacccagaacgccaucgacaagaucacgaacaaggugaacucggucaucgagaagaugaacacccaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcaaccagcugaagaacaacgccaaggagaccgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagucgacccgcaucuaccagauccuggccaucuacuccaccgucgcgucgucccuggugcucguggucagccugggggccaucucguucuggaugugcuccaacggcagccugcagugccggaucugcaucuga

SEQ ID NO: 13177 - RNA, 1701 nt, Artificial Sequence; identical to SEQ ID NO: 7069
  derived and/or modified CDS sequence (AUadapt) from InfluenzaA__AJJ99921__HA

SEQ ID NO: 13178 - RNA, 1701 nt, Artificial Sequence
  derived and/or modified CDS sequence (AUadapt) from InfluenzaA__AJJ99932__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugucguccuucgagcgcuucgagaucuuccccaagaccagcuccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgguacuccaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccgggucgggcaucaucaucuccgacacccccgugcacgacugcaacacgaccugccagaccccgaagggcgccaucaacaccagccugcccuuccagaacauccaccccaucaccaucgggaagugccccaaguacgugaaguccaccaagcugcggcucgcgacgggccugcgcaacgucccgucgauccagucccgggggcuguucggcgccaucgccggguucaucgagggcggcuggaccgggaugguggacggcugguacggguaccaccaccagaacgagcagggcagcggguacgccgccgaccucaaguccacccagaacgcgaucgacaagaucaccaacaaggugaacucggucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgggaggagaucgacggcgugaagcucgagagcacccgcaucuaccagauccuggcgaucuacuccaccgucgccucgucccuggugcucguggucagccugggggccaucucguucuggaugugcuccaacggcagccugcagugccggaucugcaucuga

SEQ ID NO: 13179 - RNA, 1701 nt, Artificial Sequence; identical to SEQ ID NO: 6699
  derived and/or modified CDS sequence (AUadapt) from InfluenzaA__AJJ99943__HA

SEQ ID NO: 13180 - RNA, 1701 nt, Artificial Sequence
  derived and/or modified CDS sequence (AUadapt) from InfluenzaA__AJJ99954__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagaaguucgagaucuuccccaagaccucguccuggcccaaccacgacucgaacaagggggucaccgccgccugcccgcacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagucgcuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucacgucggacacccccgugcacgacugcaacacgaccugccagaccccgaagggcgccaucaacaccucccugcccuuccagaacauccaccccaucaccaucgggaacugccccaaguacgucaagagcaccaagcugcgccucgcgacgggccugcggaacgugccguccauccagucgcgcgggcuguucggcgccaucgccggguucaucgagggcggcuggaccgggaugguggacggcugguacggguaccaccaccagaacgagcagggcuccggguacgccgccgaccucaagucgacccagaacgcgaucgacaagaucaccaacaaggugaacuccgucaucgagaagaugaacacgcaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagucggugaagaacgggaccuacgacuaccccaaguacuccgaggaggccaagcugaaccgcgaggagaucgacggcgugaagcucgagagcacccggaucuaccagauccuggcgaucuacuccaccgucgccucgagccuggugcucguggucucccugggggccaucucguucuggaugugcuccaacggcagccugcagugccgcaucugcaucuga

SEQ ID NO: 13181 - RNA, 1701 nt, Artificial Sequence; identical to SEQ ID NO: 3156
  derived and/or modified CDS sequence (AUadapt) from InfluenzaA__AJJ99965__HA

SEQ ID NO: 13182 - RNA, 1698 nt, Artificial Sequence
  derived and/or modified CDS sequence (AUadapt) from InfluenzaA__AJJ99989__HA
augaaggugaagcugcucguccugcugugcaccuucaccgccacguacgccgacaccaucugcaucggcuaccacgcgaacaacucgaccgacaccguggacacggugcucgagcgcaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccucgugcucccacaacggcgagagcuccuucuaccggaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugucggucgugagcucccacuacagcaagaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacucgucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagcggucgacccagaacgccaucaacggcaucacgaacaaggugaacuccgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacucgaccguggccagcucccuggugcuccuggucagccugggggccaucuccuucuggaugugcagcaacggcucccuccagugccgcaucugcaucuga

SEQ ID NO: 13183 - RNA, 1701 nt, Artificial Sequence
  derived and/or modified CDS sequence (AUadapt) from InfluenzaA__AJK00001__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcgggccggcgagaaguccuucuacaagaaccugaucuggcucgugaagaaggggaacagcuaccccaagcuguccaagucguacaucaacgacaagggcaaggaggugcugguccucugggggauccaccaccccagcaccacggcggaccagcagucccuguaccagaacgccgacgccuacguguucgugggcaccucgcgcuacuccaagaaguucaagcccgagaucgccauccggccgaagguccgcgaccaggagggccggaugaacuacuacuggacccugguggagcccggggacaagaucaccuucgaggccacgggcaaccuccuggugccccgcuacgcguucgccauggagcggaacgccgggucgggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcuccgccuggccacgggccugcggaacgugccgucgauccagucccgcggccucuucggggcgaucgccggguucaucgagggcggcuggaccgggauggucgacggcugguacggguaccaccaccagaacgagcagggcagcggguacgccgccgaccugaaguccacccagaacgccaucgacaagaucaccaacaaggugaacucggugaucgagaagaugaacacgcaguucaccgcggucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacuccaacgugaagaaccuguacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgcgagaagaucgacggcgugaagcuggagagcacccggaucuaccagauccuggccaucuacuccaccguggcgucgucccucguccugguggugagccugggggccaucucguucuggaugugcuccaacggcagccuccagugccgcaucugcaucuga

SEQ ID NO: 13184 - RNA, 1701 nt, Artificial Sequence
  derived and/or modified CDS sequence (AUadapt) from InfluenzaA__AJK00012__HA
augaaggccauccuggugguccuccugugcaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccucguccgacaacggcacgugcuaccccggcgacuucaucgacuacgaggagcuccgggagcagcugagcuccgugucguccuucgagcgcuucgagaucuuccccaagaccagcuccuggcccaaccacgacucgaacaagggggucaccgccgccugcccgcacgccggcgcgaagggguucuacaagaaccugaucuggcucgugaagaagggcaacuccuaccccaagcugucgaaguccuacaucaacgacaaggggaaggaggugcugguccucuggggcauccaccaccccagcaccacggccgaccagcagucgcuguaccagaacgccgacaccuacguguucgugggcaccucccgguacagcaagaaguucaagcccgagaucgccauccgcccgaagguccgggaccaggaggggcgcaugaacuacuacuggacccugguggagcccggcgacaagaucacguucgaggccaccgggaaccucguggucccccgguacgcguucgccauggagcgcaacgccggcuccggcaucaucaucucggacaccaccgugcacgacugcaacacgaccugccagacccccaagggggccaucaacaccucccugccguuccagaacauccaccccaucacgaucggcaagugccccaaguacgucaagucgaccaagcugcggcucgccaccgggcugcgcaacgugcccuccauccagagccggggccuguucggggcgaucgccggcuucaucgagggcggguggaccggcaugguggacgggugguacggcuaccaccaccagaacgagcagggguccggcuacgccgccgaccucaagucgacgcagaacgccaucgacaagaucaccaacaaggugaacuccgucaucgagaagaugaacacccaguucaccgcggugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacagcaacgugaagaaccucuacgagaagguccgcaaccagcugaagaacaacgccaaggagaucggcgacgggugcuucgaguucuaccacaagugcgacaacacgugcauggaguccgugaagaacggcaccuacgacuacccgaaguacucggaggaggccaagcugaaccgggagaagaucgacggggugaagcucgaguccacccgcaucuaccagauccuggccaucuacucgaccgucgcguccagccuggugcucguggucucccugggcgccaucucguucuggaugugcagcaacggcucccugcagugccggaucugcaucuga

SEQ ID NO: 13185 - RNA, 1701 nt, Artificial Sequence
  derived and/or modified CDS sequence (AUadapt) from InfluenzaA__AJK00023__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucaacuacgaggagcuccgggagcagcugucguccgugucguccuucgagcgcuucgagaucuuccccaagaccagcuccuggcccaaccacgacucgaacaagggggucaccgccgccugcccgcgggccggcgcgaaguccuucuacaagaaccugaucuggcucgugaagaaggggaacagcuaccccaagcuguccaagucguacaucaacgacaagggcaaggaggugcugguccucugggggauccaccaccccagcaccacggccgaccagcagucccuguaccagaacgccgacgccuacguguucgugggcaccucgcgcuacuccaagaaguucaagcccgagaucgccauccggccgaagguccgcgaccaggagggccggaugaacuacuacuggacccugguggagcccggggacaagaucaccuucgaggcgacgggcaaccuccuggugccccgcuacgccuucgccauggagcggaacgccgggucgggcaucaucaucuccgacacccccguccacgacugcaacacgaccugccagaccccgaagggcgccaucaacaccagccugcccuuccagaacauccaccccaucaccaucgggaagugccccaaguacgugaaguccaccaagcuccgccuggcgacgggccugcggaacgugccgucgauccagucccgcggccucuucggggccaucgccggguucaucgagggcggcuggaccgggauggucgacggcugguacggguaccaccaccagaacgagcagggcagcggguacgccgccgaccugaaguccacccagaacgcgaucgacaagaucaccaacaaggugaacucggugaucgagaagaugaacacgcaguucaccgccgucggcaaggaguucaaccaccuggagaagcggaucgagaaccucaacaagaagguggacgacggcuuccuggacaucuggaccuacaacgccgagcugcucguccugcuggagaacgagcgcacccucgacuaccacgacuccaacgugaagaaccuguacgagaaggugcggaaccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgcgaggagaucgacggcgugaagcuggagagcacccggaucuaccagauccuggcgaucuacuccaccguggccucgucccucguccugguggugagccugggggccaucucguucuggaugugcuccaacggcagccuccagugccgcaucugcaucuga

SEQ ID NO: 13186 - RNA, 1701 nt, Artificial Sequence; identical to SEQ ID NO: 7069
  derived and/or modified CDS sequence (AUadapt) from InfluenzaA__AJK00034__HA

SEQ ID NO: 13187 - RNA, 1701 nt, Artificial Sequence; identical to SEQ ID NO: 7287
  derived and/or modified CDS sequence (AUadapt) from InfluenzaA__AJK00045__HA

SEQ ID NO: 13188 - RNA, 1701 nt, Artificial Sequence; identical to SEQ ID NO: 7287
  derived and/or modified CDS sequence (AUadapt) from InfluenzaA__AJK00056__HA

SEQ ID NO: 13189 - RNA, 1701 nt, Artificial Sequence; identical to SEQ ID NO: 3156
  derived and/or modified CDS sequence (AUadapt) from InfluenzaA__AJK00067__HA

SEQ ID NO: 13190 - RNA, 1698 nt, Artificial Sequence
  derived and/or modified CDS sequence (AUadapt) from InfluenzaA__AJK00079__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggucguacaucguggagaagcccaaccccgagaacgggaccugcuaccccggccacuucgccgacuacgaggagcugcgcgagcagcucuccagcguguccagcuucgagcgguucgagaucuucccgaaggaguccucguggcccaaccacacggucaccgggguguccgccagcugcucccacaacggcgagaacagcuucuaccgcaaccugcuguggcucacccggaagaacgggcuguaccccaaccuguccaagucguacgccaacaacaaggagaaggaggugcucguccuguggggcgugcaccacccgcccaacaucgccgaccagaagacccuguaccacacggagaacgccuacguguccgucgugagcagccacuacucccgcaaguucacccccgagaucgccaagcggcccaaggugcgcgaccaggaggggcggaucaacuacuacuggacccuccuggagcccggcgacaccaucaucuucgaggcgaacggcaaccugaucgccccgcgcuacgccuucgcccucucgcggggguucggcuccgggaucaucaacagcaacgcccccauggacaagugcgacgcgaagugccagacgccccagggcgccaucaacuccagccugcccuuccagaacguccacccggugaccaucggcgagugccccaaguacgugcgcuccgccaagcugcggauggucaccgggcuccgcaacauccccucgauccagucccggggccuguucggggccaucgccggcuucaucgagggcggcuggaccggcaugguggacgggugguacggcuaccaccaccagaacgagcaggggagcggcuacgcggccgaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggcuucaucgacaucuggacguacaacgccgagcugcuggugcuccuggagaacgagcgcacccuggacuuccacgacuccaacgugaagaaccucuacgagaaggucaagucgcagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgggagaagaucgacggcgugaagcucgagagcaugggggucuaccagauccuggccaucuacuccaccguggccucgagccuggugcuccuggucucccugggcgccaucagcuucuggaugugcuccaacggcagccuccagugccgcaucugcaucuga

SEQ ID NO: 13191 - RNA, 1698 nt, Artificial Sequence
  derived and/or modified CDS sequence (AUadapt) from InfluenzaA__AJK00091__HA
augaaggugaagcugcucguccugcugugcaccuucaccgccacguacgccgacaccaucugcaucggcuaccacgcgaacaacucgaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccucgguguccagcuucgagcgguucgagaucuucccgaaggaguccagcuggcccaaccacacgaucaccggggucuccgccagcugcucccacaacggcgagucguccuucuaccgcaaccugcuguggcucaccgggaagaacggccuguaccccaaccugagcaaguccuacgccaacaacaaggagaaggaggugcucgugcuguggggcguccaccacccgcccaacaucggcgugcagaaggcccuguaccacaccgagaacgccuacgugagcgucgugagcucccacuacucgcggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagucgcgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagucgaagcugaaccgcgagaagaucgacggcgugaagcucgaguccaugggcgucuaccagauccuggccaucuacagcaccguggccagcucccuggugcuccuggucagccugggggccguguccuucuggaugugcagcaacggcucccuccagugccgggugugcaucuga

SEQ ID NO: 13192 - RNA, 1698 nt, Artificial Sequence; identical to SEQ ID NO: 2733
  derived and/or modified CDS sequence (AUadapt) from InfluenzaA__AJK00103__HA

SEQ ID NO: 13193 - RNA, 1701 nt, Artificial Sequence; identical to SEQ ID NO: 7165
  derived and/or modified CDS sequence (AUadapt) from InfluenzaA__AJK00114__HA

SEQ ID NO: 13194 - RNA, 1701 nt, Artificial Sequence
  derived and/or modified CDS sequence (AUadapt) from InfluenzaA__AJK00125__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcgaggucgcgccccugcaccucggcaagugcaacaucgccggguggauccugggcaacccggagugcgagagccuguccaccgcgucguccuggagcuacaucguggagaccuccucguccgacaacgggacgugcuaccccggcgacuucaucgacuacgaggagcuccgggagcagcugagcuccgugucguccuucgagcgcuucgagaucuuccccaagaccaacagcuggcccaaccacgacuccaacaagggcgucaccgccgccugcccgcacgccggggccaagucguucuacaagaaccugaucuggcucgugaagaagggcaacuccuaccccaagcugagcaaguccuacaucaacgacaaggggaaggaggugcugguccucuggggcauccaccaccccucgaccagcgccgaccagcagucccuguaccagaacgccgacgccuacguguucguggggacgucgcgguacuccaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcagcgggaucaucaucuccgacacgcccguguacgacugcaacacgaccugccagaccccgaagggcgccaucaacaccucgcugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggucgggcuacgccgccgaccucaaguccacccagaacgcgaucgacgagaucaccaacaaggugaacagcgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcucgcagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggagaagaucgacggggugaagcucgaguccacccgcaucuaccagauccuggcgaucuacucgaccgucgccuccagccuggugcucguggucucgcugggcgccaucuccuucuggaugugcagcaacgggucccugcagugccggaucugcaucuga

SEQ ID NO: 13195 - RNA, 1701 nt, Artificial Sequence; identical to SEQ ID NO: 116
  derived and/or modified CDS sequence (AUadapt) from InfluenzaA__AJK00136__HA

SEQ ID NO: 13196 - RNA, 1704 nt, Artificial Sequence
  derived and/or modified CDS sequence (AUadapt) from InfluenzaA__AJK00166__HA
auggagaagaucgugcugcuccuggccaucgucucgcuggugaaguccgaccagaucugcaucggcuaccacgccaacaacucgaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagucguccuggagcgaccacgaggccuccucgggcgucuccagcgcgugcccguaccagggcaagcccuccuucuuccgcaacgugguguggcugaucaagaagaacaacaccuaccccacgaucaagcggucguacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggucgaaggugaacgggcaguccggccgcauggacuucuucuggacgauccucaagcccaacgacgcgaucaacuucgagagcaacgggaacuucaucgcccccgaguacgccuacaagaucgucaagaagggcgacucggccaucaugaaguccgagguggaguacggcaacugcaacaccaagugccagaccccgaucggggccaucaacagcuccaugcccuuccacaacauccacccccugaccaucggcgagugccccaaguacgucaagucgaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagucgacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacucggaggaggcccgccucaagcgggaggagaucuccggggugaagcuggagagcaucggcaccuaccagauccuguccaucuacucgacggucgcguccagccucgcccuggccaucaugguggccgggcugucccucuggaugugcucgaacggcagccugcagugccgcaucugcaucuga

SEQ ID NO: 13197 - RNA, 1707 nt, Artificial Sequence
  derived and/or modified CDS sequence (AUadapt) from InfluenzaA__AJK00177__HA
auggagaagaucgugcugcuccuggccgucgugucgcuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgucaagccccucauccugcgggacugcuccguggccggguggcugcucggcaacccgaugugcgacgaguucaucaacgugcccgaguggucguacaucgucgagaaggccaaccccgccaacgaccugugcuaccccgggaaccugaacgacuacgaggagcucaagcaccuccugucccgcaucaaccacuucgagaagauccagaucauccccaagagcuccuggucggaccacgaggccucccugggcgugagcuccgcgugcccguaccagggcacccccucguucuuccggaacguggucuggcugaucaagaagaacaacacguaccccaccaucaagcgcuccuacaacaacaccaaccaggaggaccugcucauccugugggggauccaccacagcaacgacgaggccgagcagaucaagcuguaccagaacccgaccacguacguguccgugggcaccucgacccucaaccagcggcugguccccaagaucgccacccgcuccaaggugaacgggcagagcggccggauggacuucuucuggacgauccugaagcccgacgacgccaucaacuucgaguccaacgggaacuucaucgcgcccgaguacgccuacaagaucgugaagaagggcgacagcgccaucaugaaguccgaggucgaguacggcaacugcaacaccaagugccagaccccgaucggggccaucaacucgagcaugcccuuccacaacauccacccccucaccaucggcgagugccccaaguacgugaaguccaacaagcuggugcuggccacggggcuccgcaacucgccgcugcgggagaagcgccggcgcaagcggggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacucgaucaucgacaagaugaacacccaguucgaggcggucgggcgcgaguucaacaaccucgagcggcgcaucgagaaccugaacaagaagauggaggacggcuuccuggacguguggacguacaacgccgagcuccugguccugauggagaacgagcggacccucgacuuccacgacuccaacgugaagaaccuguacgacaaggugcgccugcagcuccgggacaacgccaaggagcuggggaacggcugcuucgaguucuaccacaagugcgacaacgagugcauggagagcguccgcaacggcaccuacgacuacccccaguacuccgaggaggcccggcugaagcgcgaggagaucucgggggugaagcucgaguccaucggcaucuaccagauccugagcaucuacuccaccguggccucgucccuggcgcucgccaucauggucgccgggcugagccuguggaugugcuccaacggcagccuccagugccgcaucugcaucuga

SEQ ID NO: 13198 - RNA, 1704 nt, Artificial Sequence
  derived and/or modified CDS sequence (AUadapt) from InfluenzaA__AJK00188__HA
auggagaagaucgugcugcuccuggccgucgugucgcuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgucaagccccucauccugcgggacugcuccguggccggguggcugcucggcaacccgaugugcgacgaguucaucaacgugcccgaguggucguacaucgucgagaaggccaaccccgccaacgaccugugcuaccccgggaaccugaacgacuacgaggagcucaagcaccuccugucccgcaucaaccacuucgagaagauccagaucauccccaagagcuccuggucggaccacgaggccucccugggcgugagcuccgcgugcccguaccagggcacccccucguucuuccggaacguggucuggcugaucaagaagaacaacacguaccccaccaucaagcgcuccuacaacaacaccaaccaggaggaccugcucauccugugggggauccaccacagcaacgacgaggccgagcagaucaagcuguaccagaacccgaccacguacaucuccgugggcaccucgacccucaaccagcggcuggugcccaagaucgccacccgcuccaaggucaacgggcagagcggccggauggacuucuucuggacgauccugaagcccgacgacgccaucaacuucgaguccaacgggaacuucaucgcgcccgaguacgccuacaagaucgugaagaagggcgacucggccaucaugaaguccgagguggaguacggcaacugcaacaccaagugccagaccccgaucggggccaucaacagcucgaugcccuuccacaacauccacccccucaccaucggcgagugccccaaguacgucaaguccaacaagcuggugcuggccacggggcuccgcaacagcccgcugcgggagaagcgccggaagcgcggccuguucggcgcgaucgccggguucaucgagggcggguggcagggcaugguggacgggugguacggcuaccaccacuccaacgagcagggcucgggguacgccgccgacaaggaguccacccagaaggccaucgacggcgucaccaacaaggugaacagcaucaucgacaagaugaacacccaguucgaggcgguggggcgggaguucaacaaccucgagcgccggaucgagaaccugaacaagaagauggaggacggcuuccuggacgucuggacguacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagucggugcggaacggcaccuacgacuacccccaguacuccgaggaggcccgccugaagcgggaggagaucagcggggucaagcucgaguccaucggcaccuaccagauccugucgaucuacuccacgguggccagcucccuggcgcucgccaucaugguggccgggcugucgcuguggaugugcuccaacggcagccuccagugccgcaucugcaucuga

SEQ ID NO: 13199 - RNA, 1704 nt, Artificial Sequence
  derived and/or modified CDS sequence (AUadapt) from InfluenzaA__AJK00207__HA
auggagaagaucgugcugcuccuggccaucgucucgcuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccucgggcgucuccagcgcgugcccguaccagggcacccccuccuucuuccggaacgugguguggcugaucaagaagaacaacacguaccccaccaucaagcgcagcuacaacaacaccucccaggaggaccuccugguccugugggggauccaccacucgaacgacgccaccgagcagaugaagcucuaccagaacccgacgaccuacguguccgugggcaccagcacccugaaccagcggcugguccccaagaucgccacgcgcuccaaggugaacgggcagucgggccggauggacuucuucuggaccauccucaagagcaacgacgccaucaacuucgaguccaacgggaacuucaucgcgcccgaguacgccuacaagaucgugaagaagggcgacagcgccaucaugaaguccgaggucgaguacggcaacugcucgaccaagugccagacccccaucggggccaucaacuccagcaugccguuccacaacauccacccccugacgaucggcgagugccccaaguacgugaaguccaacaagcuggugcucgccaccgggcugcgcaacagcccccugcgggagcgccggcgcaagcggggccucuucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacgcaguucgaggcggucgggcgcgaguucaacaaccuggagcggcgcaucgagaaccugaacaagaagauggaggacggcuuccucgacguguggaccuacaacgccgagcugcugguccucauggagaacgagcggacccuggacuuccacgacuccaacgugaagaaccuguacgacaaggugcgccuccagcugcgggacaacaccaaggagcuggggaacggcugcuucgaguucuaccacaagugcgacaacgagugcauggagucgguccgcaacggcacguacgacuacccgcaguacuccgaggaggcccggcucaagcgcgaggagaucagcggggugaagcuggaguccaucggcaccuaccagauccugagcaucuacuccaccguggccucgagccucgcccuggcgaucauggucgccgggcugucccucuggaugugcagcaacggcucccugcagugccgcaucugcaucuga

SEQ ID NO: 13200 - RNA, 1704 nt, Artificial Sequence
  derived and/or modified CDS sequence (AUadapt) from InfluenzaA__AJK00218__HA
auggagaagaucgugcuguuccucgccaucgucucgcuggugcgcuccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgggacugcuccgucgccggguggcugcugggcaacccgaugugcgacgaguucaucaacgugcccgaguggucguacaucguggagaaggccaaccccgccaacgaccucugcuaccccgggaacuucaacgacuacgaggagcugaagcaccuccugucccgcaucaaccacuucgagaagauccggaucauccccaagagcuccuggccggaccacgaggccagcuccggcgucucguccgcgugccccuaccagggcacccccagcuucuuccgcaacaucguguggcugaucaagaagaacaacacguacccgaccaucaagcgguccuacaacaacaccagccaggaggaccugcucgugcugugggggauccaccacuccucggacgccaccgagcagaucaagcuguaccagaaccccacgaccuacgucuccgugggcaccagcacccucaaccagcgccuggugcccaagaucgccacgcgguccaaggucaacgggcagucgggccgcauggacuucuucuggaccauccucaagagcaacgacgccaucaacuucgaguccaacgggaacuucaucgcgcccgaguacgccuacaagaucgugaagaagggcgacagcgccaucaugaaguccgagguggaguacggcaacugcucgaccaagugccagaccccgaucggggccaucaacuccagcaugcccuuccacaacauccacccccugacgaucggcgagugccccaaguacgucaaguccaacaagcuggugcuggccaccgggcuccggaacagcccgcugcgcgagcggcgccggaagcgcggccuguucggcgcgaucgccggguucaucgagggcggguggcagggcaugguggacgggugguacggcuaccaccacuccaacgagcagggcucgggguacgccgccgacaaggaguccacccagaaggccaucgacggcgucaccaacaaggugaacagcaucaucgacaagaugaacacgcaguucgaggcgguggggcgggaguucaacaaccucgagcgccggaucgagaaccugaacaagaagauggaggacggcuuccuggacgucuggaccuacaacgccgagcuccuggugcugauggagaacgagcgcacccucgacuuccacgacuccaacgucaagaaccuguacgacaaggugcggcugcagcuccgcgacaacgccaaggagcuggggaacggcugcuucgaguucuaccacaagugcgacaacgagugcauggagucggugcggaacggcaccuacgacuacccccaguacuccgaggaggcccgccugaagcgcgaggagaucagcggggucaagcucgaguccaucggcacguaccagauccugagcaucuacuccaccgccgcgucgagccuggcccucgccaucaugguggccgggcugucccuguggaugugcagcaacggcucccuccagugccggaucugcaucuga

SEQ ID NO: 13201 - RNA, 1704 nt, Artificial Sequence
  derived and/or modified CDS sequence (AUadapt) from InfluenzaA__AJK00239__HA
auggagaagaucgugcugcuccuggccaucgucucgcuggugcgcuccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgggacugcuccgucgccggguggcugcucggcaacccgaugugcgacgaguucaucaacgugcccgaguggucguacaucguggagaaggccaaccccgccaacgaccugugcuaccccgggaacuucaacgacuacgaggagcugaagcaccuccugucccgcaucaaccacuucgagaagauccagaucauccccaagagcuccuggagcgaccacgaggccuccucgggcgucuccagcgcgugcccguaccagggcacccccuccuucuuccggaacgugguguggcugaucaagaagaacaacacguaccccaccaucaagcgcagcuacaacaacaccucccaggaggaccuccugguccugugggggauccaccacucgaacgacgccaccgagcagaugaagcucuaccagaacccgacgaccuacguguccgugggcaccagcacccugaaccagcggcugguccccaagaucgccacgcgcuccaaggugaacgggcagucgggccggauggacuucuucuggaccauccucaagagcaacgacgccaucaacuucgaguccaacgggaacuucaucgcgcccgaguacgccuacaagaucgugaagaagggcgacagcgccaucaugaaguccgaggucgaguacggcaacugcucgaccaagugccagacccccaucggggccaucaacuccagcaugccguuccacaacauccacccccugacgaucggcgagugccccaaguacgugaaguccaacaagcuggugcucgccaccgggcugcgcaacagcccccugcgggagcgccggcgcaagcggggccucuucggcgcgaucgccggguucaucgagggcggguggcagggcauggucgacgggugguacggcuaccaccacuccaacgagcagggcucgggguacgccgccgacaaggaguccacccagaaggccaucgacggcgugaccaacaaggugaacagcaucaucgacaagaugaacacgcaguucgaggcggucgggcgcgaguucaacaaccuggagcggcgcaucgagaaccugaacaagaagauggaggacggcuuccucgacguguggaccuacaacgccgagcugcugguccucauggagaacgagcggacccuggacuuccacgacuccaacgugaagaaccuguacgacaaggugcgccuccagcugcgggacaacgccaaggagcuggggaacggcugcuucgaguucuaccacaagugcgacaacgagugcauggagucgguccgcaacggcaccuacgacuacccgcaguacuccgaggaggcccggcucaagcgcgaggagaucagcggggugaagcuggaguccaucggcacguaccagauccugagcaucuacuccaccguggccucgagccucgcgcuggccaucauggucgccgggcugucccucuggaugugcagcaacggcucccugcagugccgcaucugcaucuga

SEQ ID NO: 13202 - RNA, 1704 nt, Artificial Sequence
  derived and/or modified CDS sequence (AUadapt) from InfluenzaA__AJS18468__HA
auggagaagaucgugcugcuccuggccgucgugucgcuggugaaguccgaccagaucugcaucggcuaccacgccaacaacucgaccgagcaggucgacaccaucauggagaagaacgugacggugacccacgcgcaggacauccucgagaagacccacaacgggcgccugugcgaccugaacggcgucaagccccucauccugaaggacugcuccguggccggguggcugcucggcaacccgaugugcgacgaguucauccgggugcccgaguggagcuacaucgucgagcgcgccaaccccgccaacgaccugugcuaccccgggaaccugaacgacuacgaggagcucaagcaccuccugucccggaucaaccacuucgagaagacccugaucauccccaagucguccuggccgaaccacgagacgagccugggcguguccgccgcgugccccuaccagggcgugcccucguucuuccgcaacgucguguggcugaccaagaagaacgacgccuacccgaccaucaagauguccuacaacaacaccaaccgggaggaccuccugauccugugggggauccaccacucgaacaacgccgccgagcagacgaaccucuacaagaaccccaccaccuacguguccgucggcaccagcacgcugaaccagcgccuggugcccaagaucgcgacccggucccaggugaacgggcagcgcggccggauggacuucuucuggaccauccucaagcccaacgacgccauccacuucgagucgaacgggaacuucaucgccccggaguacgccuacaagaucgucaagaagggcgacuccaccaucaugaaguccgagauggaguacggccacugcaacacgaagugccagacccccaucggggccaucaacuccagcaugcccuuccacaacauccacccccugaccaucggcgagugcccgaaguacgucaagucgaacaagcuggugcucgcgaccgggcugcgcaacucgccccugcgggagcgccggcgcaagcggggccucuucggcgccaucgccggguucaucgagggcggguggcagggcaugguggacgggugguacggcuaccaccacagcaacgagcagggcuccggguacgccgccgaccgcgagucgacgcagaaggcgaucgacggcgugaccaacaaggugaacuccaucaucgacaagaugaacacccaguucgaggccgucgggcgggaguucaacaaccuggagcgccggaucgagaaccugaacaagaagauggaggacggcuuccucgacguguggaccuacaacgccgagcugcugguccucauggagaacgagcgcacgcuggacuuccacgacagcaacgugaagaaccuguacgacaaggugcggcuccagcugcgcgacaacgccaaggagcuggggaacggcugcuucgaguucuaccacaagugcgacaacgagugcauggaguccguccgcaacggcaccuacgacuacccccaguacucggaggaggcccggcucaagcgcgaggagaucuccggggugaagcuggagucgaucggcaccuaccagauccuguccaucuacagcaccguggcguccucgcucacgcuggccaucaucgucgccgggcugucccucuggaugugcagcaacggcucccugcagugccggaucugcaucuga

SEQ ID NO: 13203 - RNA, 1704 nt, Artificial Sequence; identical to SEQ ID NO: 221
  derived and/or modified CDS sequence (AUadapt) from InfluenzaA__AJS18479__HA

SEQ ID NO: 13204 - RNA, 1704 nt, Artificial Sequence
  derived and/or modified CDS sequence (AUadapt) from InfluenzaA__AJY79339__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaaccugaacgacuacgaggagcucaagcaccuccugucccggaucaaccacuucgagaagauccagaucaucccgaaggacucgugguccgaccacgaggccucgggcgucuccagcgccugccccuaccagggccgcuccucguucuuccggaacgugguguggcugaccaagaagaacgacgcguaccccacgaucaagaaguccuacaacaacaccaaccaggaggaccugcugguccucugggggauccaccaccccaacgacgccgccgagcagacccgccuguaccagaacccgaccacguacaucucggugggcaccuccacccugaaccagcggcucgugcccaagaucgccacccgcagcaaggucaacgggcaguccggccggauggaguucuucuggacgauccucaagucgaacgacgcgaucaacuucgaguccaacgggaacuucaucgcccccgagaacgccuacaagaucgugaagaagggcgacucgaccaucaugaaguccgagcuggaguacuccaacugcaacaccaagugccagacccccaucggcgccaucaacagcuccaugccguuccacaacauccacccccugacgaucggggagugccccaaguacgucaagucgaaccgccuggugcuggccaccggccuccggaacucgccccagggggagaagcgccggaagaagcgcggccuguucggcgcgaucgccggguucaucgagggcggguggcagggcaugguggacgggugguacggcuaccaccacagcaacgagcagggcuccggguacgccgccgacaaggagucgacccagcgggccaucgacggcgugaccaacaaggucaacuccaucaucgacaagaugaacacgcaguucgaggcgguggggcgcgaguucaacaaccuggagcggcgcaucgagaaccucaacaagaagauggaggacggcuuccuggacguguggaccuacaacgccgagcugcucguccugauggagaacgagcggacccuggacuuccacgacucgaacgugaagaaccucuacgacaagguccgccugcagcugcgggacaacgccaaggagcucgggaacggcugcuucgaguucuaccaccgcugcgacaacgagugcauggaguccgugcggaacggcaccuacgacuacccgcaguacagcgaggaggcccgccugaagcgcgaggagaucuccggggugaagcuggagucgaucggcacguaccagauccucuccaucuacucgaccgucgccuccagccuggcgcuggccaucaugguggccgggcucucccuguggaugugcucgaacggcagccugcagugccggaucugcaucuga

SEQ ID NO: 13205 - RNA, 1704 nt, Artificial Sequence
  derived and/or modified CDS sequence (AUadapt) from InfluenzaA__AJY79341__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacucgugguccgaccacgagaccucgggcgucuccagcgccugccccuaccagggccgcuccucguucuuccggaacgugguguggcugacgaagaagaacgacgccuaccccaccaucaagaaguccuacaacaacaccaaccaggaggaccuccugguccugugggggauccaccaccccaacgacgcggccgagcagacccgccucuaccagaacccgacgaccuacaucucggugggcaccuccacccugaaccagcggcuggugcccaagaucgccacgcgcagcaaggucaacgggcagaacggccggauggaguucuucuggaccauccucaaguccaacgacgccaucaacuucgagucgaacgggaacuucaucgcgcccgagaacgccuacaagaucgugaagaagggcgacuccaccaucaugcgcagcgagcuggaguacucgaacugcaacaccaagugccagacgcccaucggcgccaucaacuccucgaugccguuccacaacauccacccccugaccaucggggagugccccaaguacgugaaguccaaccggcucguccuggccaccggccugcgcaacagcccccagggggagaagcggcgcaagaagcggggccucuucggcgccaucgcgggguucaucgagggcggguggcagggcaugguggacgggugguacggcuaccaccacuccaacgagcagggcucgggguacgccgccgacaaggaguccacccagcgcgccaucgacggcgugacgaacaaggucaacucgaucaucgacaagaugaacacccaguucgaggccguggggcgggaguucaacaaccuggagcgccggaucgagaaccugaacaagaagauggaggacggcuuccucgacguguggaccuacaacgcggagcugcugguccucauggagaacgagcgcacccuggacuuccacgacuccaacgugaagaaccuguacgacaagguccggcuccagcugcgcgacaacgccaaggagcuggggaacggcugcuucgaguucuaccaccggugcgacaacgagugcauggagagcgugcgcaacggcacguacgacuacccgcaguacuccgaggaggcccgccucaagcgggaggagaucucgggggugaagcuggaguccaucggcaccuaccagauccugucgaucuacuccaccgucgccagcucccucgcccuggcgaucaugguggccgggcugucgcucuggaugugcuccaacggcagccugcagugccgcaucugcaucuga

SEQ ID NO: 13206 - RNA, 1704 nt, Artificial Sequence
  derived and/or modified CDS sequence (AUadapt) from InfluenzaA__AJY79342__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacucgugguccgaccacgaggccucgggcgucuccagcgccugccccuaccagggccgcuccucguucuuccggaacgugguguggcugaccaagaagaacgacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcucgaaggucaacgggcaguccggccggauggaguucuucuggacgauccucaagucgaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacucguccaugccguuccacaacauccacccccugacgaucggggagugccccaaguacgucaagagcaaccgccucgugcuggccaccggccugcggaacucgccccagggggagaagcgccggaagaagcgcggccucuucggcgcgaucgccggguucaucgagggcggguggcagggcaugguggacgggugguacggcuaccaccacucgaacgagcagggcuccggguacgccgccgacaaggagagcacccagcgggccaucgacggcgugaccaacaaggucaacuccaucaucgacaagaugaacacgcaguucgaggcgguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacucgaacgugaagaaccuguacgacaagguccgccuccagcugcgggacaacgccaaggagcuggggaacggcugcuucgaguucuaccaccgcugcgacaacgagugcauggaguccgugcggaacggcaccuacgacuacccgcaguacagcgaggaggcccgccucaagcgcgaggagaucuccggggugaagcuggagucgaucggcacguaccagauccuguccaucuacucgaccgucgccuccagccucgcgcuggccaucaugguggccgggcugucccucuggaugugcucgaacggcagccugcagugccggaucugcaucuga

SEQ ID NO: 13207 - RNA, 1704 nt, Artificial Sequence
  derived and/or modified CDS sequence (AUadapt) from InfluenzaA__AJY79343__HA
auggagaagaucgugcugcuccuggccaucgucucgaucgugaaguccgaccagaucugcaucggcuaccacgccaacaacucgaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaaggacucgugguccgaccacgaggccucgggcgucuccagcgccugccccuaccagggccgcuccucguucuuccggaacgugguguggcugaccaagaagaacgacgcguaccccacgaucaagaaguccuacaacaacaccaaccaggaggaccuccugguccugugggggauccaccaccccaacgacgccgccgagcagacccgccucuaccagaacccgaccacguacaucagcgugggcaccuccacccugaaccagcggcuggugcccaagaucgccacccgcucgaaggucaacgggcaguccggccggauggaguucuucuggacgauccucaagucgaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacucguccaugccguuccacaacauccacccccugacgaucggggagugccccaaguacgucaagagcaaccgccucgugcuggccaccggccugcggaacucgccccagggggagaagcgccggaagaagcgcggccucuucggcgcgaucgccggguucaucgagggcggguggcagggcaugguggacgggugguacggcuaccaccacucgaacgagcagggcuccggguacgccgccgacaaggagagcacccagcgggccaucgacggcgugaccaacaaggucaacuccaucaucgacaagaugaacacgcaguucgaggcgguggggcgcgaguucaacaaccuggagcggcgcaucgagaaccugaacaagaagauggaggacggcuuccucgacguguggaccuacaacgccgagcugcugguccucauggagaacgagcggacccuggacuuccacgacucgaacgugaagaaccuguacgacaagguccgccuccagcugcgggacaacgccaaggagcuggggaacggcugcuucgaguucuaccaccgcugcgacgacgagugcauggaguccgugcggaacggcaccuacgacuacccgcaguacagcgaggaggcccgccucaagcgcgaggagaucuccggggugaagcuggagucgaucggcacguaccagauccuguccaucuacucgaccgucgccuccagccucgcgcuggccaucaugguggccgggcugucccucuggaugugcucgaacggcagccugcagugccggaucugcaucuga

SEQ ID NO: 13208 - RNA, 1704 nt, Artificial Sequence
  derived and/or modified CDS sequence (AUadapt) from InfluenzaA__AJY79345__HA
auggagaagaucgugcugcuccuggccaucgucucgaucgugaaguccgaccagaucugcaucggcuaccacgccaacaacucgaccgagcaggucgacaccaucauggagaagaacgugacggugacccgcgcgcaggacauccuggagaagacccacaacgggaagcucugcaaccuggacggcgugaagccccugauccuccgggacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccgcaucaaccacuucgagaagauccagaucaucccgaaggacucgugguccgaccacgaggccucgggcgucuccagcgccugccccuaccagggccgguccucguucuuccgcaacgugguguggcugaccaagaagaacgacgcguaccccacgaucaagaaguccuacaacaacaccaaccaggaggaccuccugguccugugggggauccaccaccccaacgacgccgccgagcagacccggcucuaccagaacccgaccacguacaucagcgugggcaccuccacccugaaccagcgccuggugcccaagaucgccacccggucgaaggucaacgggcaguccggccgcauggaguucuucuggacgauccucaagucgaacgacgcgaucaacuucgaguccaacgggaacuucaucgcccccgagaacgccuacaagaucgugaagaagggcgacagcaccaucaugaaguccgagcuggaguacuccaacugcaacaccaagugccagacccccaucggcgccaucaacucguccaugccguuccacaacauccacccccugacgaucggggagugccccaaguacgucaagagcaaccggcucgugcuggccaccggccugcgcaacucgccccagggggagaagcggcgcaagaagcggggccucuucggcgcgaucgccggguucaucgagggcggguggcagggcaugguggacgggugguacggcuaccaccacucgaacgagcagggcuccggguacgccgccgacaaggagagcacccagcgcgccaucgacggcgugaccaacaaggucaacuccaucaucgacaagaugaacacgcaguucgaggcgguggggcgggaguucaacaaccuggagcgccggaucgagaaccugaacaagaagauggaggacggcuuccucgacguguggaccuacaacgccgagcugcugguccucauggagaacgagcgcacccuggacuuccacgacucgaacgugaagaaccuguacgacaagguccggcuccagcugcgcgacaacgccaaggagcuggggaacggcugcuucgaguucuaccaccggugcgacaacgagugcauggaguccgugcgcaacggcaccuacgacuacccgcaguacagcgaggaggcccgccucaagcgggaggagaucuccggggugaagcuggagucgaucggcacguaccagauccuguccaucuacucgaccgucgccuccagccucgcgcuggccaucaugguggccgggcugucccucuggaugugcucgaacggcagccugcagugccgcaucugcaucuga

SEQ ID NO: 13209 - RNA, 1701 nt, Artificial Sequence; identical to SEQ ID NO: 68
  derived and/or modified CDS sequence (AUadapt) from InfluenzaA__AKA54643__HA

SEQ ID NO: 13210 - RNA, 1701 nt, Artificial Sequence
  derived and/or modified CDS sequence (AUadapt) from InfluenzaA__AKA54650__HA
augaagaccaucaucgcccugucguacauccucugccugguguucacccagaagauccccggcaacgacaacuccacggccacccugugccucgggcaccacgcggucccgaacggcaccaucgugaagaccaucacgaacgaccgcaucgaggugaccaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgccucccugcgcucgcuggucgcguccagcggcacgcucgaguucaacaacgaguccuucaacuggaccggggugacccagaacggcaccucguccgccugcauccggcgcagcuccucguccuucuucagccggcugaacuggcugacgcaccucaacuacaaguaccccgcccugaacgugaccaugcccaacaacgagcaguucgacaagcuguacaucuggggcguccaccaccccgggaccgacaaggaccagaucuuccucuacgcccaguccucggggcgcaucaccgugagcacgaagcggucccagcaggcggugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggccaccggcaugcggaacguccccgagaagcagacccgcgggaucuucggcgcgaucgccggguucaucgagaacggcugggagggcaugguggacgggugguacggcuuccggcaccagaacuccgaggggcgcggccaggccgccgaccucaagucgacgcaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13211 - RNA, 1701 nt, Artificial Sequence
  derived and/or modified CDS sequence (AUadapt) from InfluenzaA__AKA54651__HA
augaagaccaucaucgccuucucgugcauccugugccagaucuccgcccagaagcuccccggcagcgacaacuccauggcgacccugugccuggggcaccacgccgugccgaacggcacgcucgucaagaccaucaccgacgaccagaucgaggugaccaacgccacggagcuggugcagucgaccuccaagggggagaucugcagcagcccccaccagauccuggacggcaagaacugcacccucaucgacgcccugcugggggacccccacugcgacgacuuccagaacaagaagugggaccucuucgucgagcgcucgaccgccuacuccaacugcuaccccuacuacgugccggacuacgcgagccugcggucccugguggccagcuccggcacgcucgaguucacccaggagucguucaacuggaccggcgucgcccaggacggggccuccuacagcugccgccgggaguccgagaacagcuucuucucccgccugaacuggcuguacucgcucaacuacaaguaccccgcgcugaacgugaccaugcccaacaacgacaaguucgacaagcuguacaucuggggcgugcaccaccccgggacggacaaggaccagaccagccucuacauccaggccuccggccgggucaccgugagcaccaaguggucccagcagacggugaucccgaacaucgggucgcgccccuggauccggggcgucuccagcaucaucuccaucuacuggaccaucgugaagcccggcgacauccugcugaucaacagcaccgggaaccucaucgcgccccgcggcuacuucaagauccaguccgggaaguccuccaucaugcggucggacgcccacaucggcaacugcaacuccgagugcaucaccccgaacggcagcauccccaacgacaagcccuuccagaacgugaaccgcaucacguacggggccugcccccgguacgucaagcagaacacccugaagcuggccaccggcaugcgcaacgugccggagaagcagacccgggggaucuucggcgccaucgccggguucaucgagaacggcugggagggcaugguggacgggugguacggcuuccgccaccagaacuccgaggggacgggccaggccgccgaccucaagagcacccaggcggccaucaaccagaucaccgggaagcugaaccgggucaucaagaagaccaacgagaaguuccaccagaucgagaaggaguucuccgagguggagggccgcauccaggaccuggagcgguacguggaggacacgaagaucgaccucuggucguacaacgccgagcugcuggucgcccucgagaaccagcacaccaucgaccugaccgacuccgagaugaacaagcuguucgagcgcacccggaagcagcuccgcgagaacgccgaggacaugggcaacgggugcuucaagaucuaccacaagugcgacaacgcgugcaucggcagcauccggaacgggacguacgaccacgacguguaccgcgacgaggccgugaacaaccgcuuccagaucaagggcguccagcugaagcugggguacaaggacuggauccucuggaucagcuucgccaucuccugcuuccugcugugcgccgugcuccugggcuucaucaugugggccugccagaagggcaacauccggugcaacaucugcaucuga

SEQ ID NO: 13212 - RNA, 1701 nt, Artificial Sequence
  derived and/or modified CDS sequence (AUadapt) from InfluenzaA__AKA59351__HA
augaaggccauccuggugauccuccuguacaccuucgccgcggccaacgccgacaccaucugcaucggcuaccacgccaacaacucgacggacaccgucgacaccgugcuggagaagaacgugaccgucacgcacuccguggaccuccuggaggacaagcacaacgggcgccugugcaagcuccggggcguggcgccccugcaccuggggaagugcaacaucgccggcuggauccucgggaacccggagugcgagucgcuguccaccgccagcuccuggucguacaucgucgagaccuccagcuccgacaacgggaccugcuaccccggcgacuucaucgacuacgaggagcugcgcgagcagcucucguccgugagcuccuucgagcgguucgagaucuuccccaagacgucguccuggcccaaccacgagagcaacaagggggugaccgccgccugcccgcaggcgggcgccaaguccuucuacaagaaccugaucuggcuggucaagaaggagaacucguaccccaagcucuccaagagcuacaucaacgacaaggggaaggaggugcuggugcuguggggcauccaccaccccucgaccuccgccgaccagcagagccucuaccagaacgccgacgccuacgucuucguggggaccucccgcuacucgaagaaguucaagcccgagaucgcgauccggccgaaggugcgcgaccaggagggccggaugaacuacuacuggacgcuggucgagcccggcgacaagaucaccuucgaggccaccgggaaccugguggugccccgcuacgccuucgccauggagcggaacgccggcuccgggaucaucaucagcgacacccccguccacgacugcaacacgaccugccagaccccgaagggcgcgaucaacaccucccuccccuuccagaacauccaccccaucacgaucggcaagugccccaaguacgucaagucgaccaagcugcgccuggccaccgggcuccggaacgugccguccauccagagccgcggccuguucggggccaucgccggcuucaucgagggcggcuggaccggcaugguggacgggugguacggcuaccaccaccagaacgagcagggguccggcuacgccgcggaccucaagucgacgcagaacgccaucgacgagaucaccaacaaggugaacuccgugaucgagaagaugaacacccaguucaccgccgucgggaaggaguucaaccaccuggagaagcggaucgagaaccugaacaagaagguggacgacggcuuccuggacaucuggacguacaacgccgagcuccugguccugcucgagaacgagcgcacccuggacuaccacgacagcaacgugaagaaccuguacgagaaggugcggucccagcucaagaacaacgccaaggagaucggcaacgggugcuucgaguucuaccacaagugcgacaacacgugcauggagucggucaagaacggcaccuacgacuaccccaaguacuccgaggaggcgaagcugaaccgcgaggagaucgacggggugaagcuggagagcacccggaucuaccagauccucgccaucuacuccaccguggccucgagccugguccugguggugucccucggcgccaucucguucuggaugugcuccaacgggagccugcagugccgcaucugcaucuga

SEQ ID NO: 13213 - RNA, 1701 nt, Artificial Sequence
  derived and/or modified CDS sequence (AUadapt) from InfluenzaA__AKA59353__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucggggagugcaacaucgccggcuggauccuggggaacccggagugcgagagccuguccaccgccucguccuggagcuacaucguggagacccccuccucgaacaacggcacgugcuaccccggcgacuucaucgacuacgaggagcuccgggagcagcuguccagcguguccucguucgagcgcuucgagaucuuccccaacaccuccagcuggccgaaccacgacuccucgaagggggucaccgccgccugcccccacgccggcgcgaaguccuucuacaagaaccugaucuggcucgugaagaaggggaacagcuaccccaagcuguccaagucguacaucaacgacaagggcaaggaggugcugguccucugggggauccaccaccccagcaccuccgccgaccagcagaagcuguaccagaacgaggacgccuacguguucgugggcacgucgcgguacuccaagaaguucaagccggagaucgccauccgccccaagguccgggaccaggagggccgcaugaacuacuacuggacccugguggagcccggggacaagaucaccuucgaggccaccggcaacaucguggucccccgguacgcguucgccauggagcgcaacgccgggagcggcaucaucaucuccgacacgccggugcacaacugcaacacgaccugccagacccccaagggcgccaucaacaccucgcuccccuuccagaacgugcaccccaucaccaucgggaagugcccgaaguacgucaaguccaccaagcugcggcuggccaccggccuccgcaacgugcccagcauccagucccgggggcuguucggcgcgaucgccggguucaucgagggcggcuggacggggaugguggacggcugguacggguaccaccaccagaacgagcagggcucgggguucgccgccgaccugaaguccacccagaacgccaucgacggcaucaccaacaaggucaacagcgugaucgagaagaugaacacccaguucacggcggucggcaaggaguucaaccaccucgagaagcgcaucgagaaccugaaccggaagaucgacgacggguuccuggacaucuggaccuacaacgccgagcuccugauccugcucgagaacgagcgcacccuggacuaccacgacuccaacgugcggaaccuguacgagaaggugcgcucgcagcucaagaacaacgccaaggagaucggcaacgggugcuucgaguucuaccacaagugcgacaacacgugcauggaguccgucaagaacggcaccuacgacuaccccaaguacagcgaggaggccaagcugaaccgggaggagaucgacggggugaagcuggaguccacccgcaucuaccagauccucgccaucuacucgaccguggcguccagccugguccugaucgugucgcucggcgccaucuccuucuggaugugcagcaacggcucccugcagugccggaucugcaucuga

SEQ ID NO: 13214 - RNA, 1701 nt, Artificial Sequence
  derived and/or modified CDS sequence (AUadapt) from InfluenzaA__AKA59355__HA
augaaggccauccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagucgcuguccaccgccagcuccuggucguacaucguggagaccuccagcuccgacaacggcacgugcuaccccggcgacuucaucgacuacgaggagcuccgggagcagcugucguccgugagcuccuucgagcgcuucgagaucuuccccaagaccucguccuggcccaaccacgacagcaacaagggggucaccgccgccugcccgcacgccggcgcgcgguccuucuacaagaaccugaucuggcucgugaagaaggggaacucguaccccaagcugaaccaguccuacaucaacgacaagggcaaggaggugcugguccucugggggauccaccacccgcccaccagcgccgaccagcagucgcuguaccagaacgccgacgccuacguguucgugggcacgucccgcuacucgaagaaguucaagcccgagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagucgaccaagcugcgccucgcgaccggccugcggaacgugcccuccauccagagccgcgggcuguucggcgccaucgccggguucaucgagggcggcuggacggggaugguggacggcugguacggguaccaccaccagaacgagcagggcuccggguacgccgccgaccucaagucgacccagaacgcgaucgacgagaucaccaacaaggugaaccuggucaucgagaagaugaacacccaguucacggccgugggcaaggaguucucccaccuggagaagcggaucgagaaccucaacaagaaggucgacgacggcuuccuggacaucuggaccuacaacgccgagcugcucgugcugcuggagaacgagcgcacccucgacuaccacgacagcaacgugaagaaccuguacgagaagauccggucccagcugaagaacaacgccaaggagaucgggaacggcugcuucgaguucuaccacaagugcgacaacacgugcauggagucggucaagaacgggaccuacgacuaccccaaguacuccgaggaggccaagcucaaccgcgaggagaucgacggcgugaagcuggagagcacccggguguaccagauccuggcgaucuacuccaccgucgccucgucccucgugcugguggucagccugggggccaucucguucuggaugugcuccaacggcagccuccagugccgcaucugcaucuga

SEQ ID NO: 13215 - RNA, 1701 nt, Artificial Sequence
  derived and/or modified CDS sequence (AUadapt) from InfluenzaA__AKE37137__HA
augaaggcccgccuggugguccuccuguacaccuucgccaccgcgaacgccgacacgcugugcaucggcuaccacgccaacaacucgaccgacaccguggacaccgugcucgagaagaacgucacggugacccacuccgugaaccugcuggaggacaagcacaacgggaagcucugcaagcugcggggcgucgcgccccugcaccucgggaagugcaacaucgccggcuggauccuggggaacccggagugcgagucgcuguccaccgcgagcuccuggucguacaucguggagaccuccagcuccgacaacggcacgugcuaccccggcgacuucaucgacuacgaggagcuccgcgagcagcugucguccgugagcuccuucgagcgguucgagaucuuccccaagaccucguccuggcccaaccacgacccgaacaagggggucaccgccgccugcccccacgccggcgccaagucguucuacaagaaccugaucuggcucgugaagaaggggaacuccuaccccaagcugagcaccuccuacaucaacgacaagggcaaggaggugcugguccucugggggauccaccaccccucgacgagcgccgaccagcagucccuguaccagaacgccgacgccuacgccuucgugggcaccucgcgcuacuccaagaaguucaagccggagaucgcgauccggcccaaggugcgcgaccgggagggccgcaugaacuacuacuggacccuggucgagcccggggacaagaucaccuucgaggccacgggcaaccucguggugccccgguacgccuucgccauggagcgcaacgccgggagcggcaucaucaucuccgacaccucgguccacgacugcaacacgaccugccagaccccgaagggcgcgaucaacaccucccugcccuuccagaacgugcaccccaucaccaucgggaagugccccaaguacgucaagagcaccaagcugcggcucgccacgggccugcgcaacgugccguccauccagucgcgggggcuguucggcgccaucgccggguucaucgagggcggcuggaccgggaugguggacggcugguacggguaccaccaccagaacgagcagggcuccggguacgccgcggaccucaagucgacccagaacgccuucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagucggugaagaacgggaccuacgacuaccccaaguacuccgaggaggcgaagcugaaccgggaggagaucgacggcgugaagcucgagagcacccgcaucuaccagauccuggccaucuacuccaccgucgccucgagccuggugcucguggucucccugggggccaucucguucuggaugugcuccaacggcagccugcagugccggaucugcaucuga

SEQ ID NO: 13216 - RNA, 1701 nt, Artificial Sequence; identical to SEQ ID NO: 224
  derived and/or modified CDS sequence (AUadapt) from InfluenzaA__AKS48035__HA

SEQ ID NO: 13217 - RNA, 1701 nt, Artificial Sequence
  derived and/or modified CDS sequence (AUadapt) from InfluenzaA__ALA08472__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacgucuggggcgugcaccaccccgggaccgacaaggaccagaucuuccucuacgcgcaguccucggggcgcaucaccgugagcacgaagcggucccagcaggccgucaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13218 - RNA, 1701 nt, Artificial Sequence; identical to SEQ ID NO: 68
  derived and/or modified CDS sequence (AUadapt) from InfluenzaA__ALA08475__HA

SEQ ID NO: 13219 - RNA, 1701 nt, Artificial Sequence
  derived and/or modified CDS sequence (AUadapt) from InfluenzaA__ALA08478__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagcggugggaccuguucguggagcgcuccaaggccuacucgaacugcuaccccuacgacgugccggacuacgcgucccugcggagccucgucgccuccucgggcacccuggaguucaacgacgaguccuucaacugggccggggugacgcagaacggcaccagcuccgccugcauccgcgggucgaacuccagcuucuucucccggcugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccaguccagcggccgcaucaccgugucgaccaagcggucccagcaggccgugaucccgaacaucggcagccgcccccggauccgcaacauccccucccggaucucgaucuacuggaccaucgucaagcccggggacauccugcugaucaacuccacgggcaaccucaucgccccgcgcggguacuucaagauccagagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcuggccacggggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggucguacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcguggagcucaaguccggcuacaaggacuggauccuguggaucucguucgccaucagcugcuuccugcucugcgucgcccugcugggguucaucaugugggcgugccagaagggcaacauccggugcaacaucugcaucuga

SEQ ID NO: 13220 - RNA, 1701 nt, Artificial Sequence; identical to SEQ ID NO: 162
  derived and/or modified CDS sequence (AUadapt) from InfluenzaA__ALA08479__HA

SEQ ID NO: 13221 - RNA, 1701 nt, Artificial Sequence
  derived and/or modified CDS sequence (AUadapt) from InfluenzaA__ALA08481__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggcccacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcucgggccggaucaccguguccaccaagcgcagccagcaggccgugaucccgaacaucggcucccggccccgcauccgggacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucucggagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagucgggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 13222 - RNA, 1701 nt, Artificial Sequence; identical to SEQ ID NO: 13221
  derived and/or modified CDS sequence (AUadapt) from InfluenzaA__ALA08482__HA

SEQ ID NO: 13223 - RNA, 1701 nt, Artificial Sequence
  derived and/or modified CDS sequence (AUadapt) from InfluenzaA__ALA08483__HA
augaagaccaucaucggccugucguacauccucugccugguguucgcccagaagcugcccgggaacgacaacuccaccgccacgcucugccugggccaccacgcggucccgaacgggaccaucgugaagaccaucaccaacgaccgcaucgaggugacgaacgccaccgagcugguccagaacagcuccaucggcgagaucugcgacucgccccaccagauccucgacggggagaacugcacccugaucgacgcccugcucggcgacccccagugcgacggcuuccagaacaagaagugggaccuguucguggagcgguccaaggccuacagcaacugcuaccccuacgacgugccggacuacgccucccugcgcucgcucgucgcguccagcgggacccuggaguucaacaacgaguccuucaacugggccggcgugacgcagaacgggaccucguccagcugcauccggggcuccaacucguccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcccagucgagcggccggaucaccguguccaccaagcgcucgcagcaggcggugaucccgaacaucgggucccggccccgcauccgggacauccccagccgcaucuccaucuacuggaccaucgucaagcccggcgacauccugcucaucaacucgacggggaaccugaucgccccgcggggcuacuucaagauccgcuccggcaagagcuccaucaugcggucggacgcccccaucgggaagugcaaguccgagugcaucacccccaacggcagcauccccaacgacaagccguuccagaacgugaaccgcaucaccuacggggccugcccccgguacgugaagcaguccacccugaagcucgccacgggcaugcgcaacguccccgagcggcagacccgcgggaucuucggcgcgaucgccggcuucaucgagaacgggugggagggcaugguggacgggugguacggcuuccggcaccagaacucggaggggcgcggccaggccgccgaccugaaguccacccaggccgcgaucgaccagaucaacggcaagcugaaccggcucaucgggaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacauggggaacggcugcuucaagaucuaccacaagugcgacaacgccugcaucggguccauccggaacggcacguacgaccacgacguguaccgcgacgaggcgcucaacaaccgguuccagaucaagggcgucgagcucaagagcggguacaaggacuggauccuguggaucagcuucgccaucuccugcuuccugcugugcguggcccugcucggcuucaucaugugggccugccagaaggggaacauccgcugcaacaucugcaucuga

SEQ ID NO: 13224 - RNA, 1701 nt, Artificial Sequence
  derived and/or modified CDS sequence (AUadapt) from InfluenzaA__ALA08484__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccaucagcacgaagcggucccagcaggccgugaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13225 - RNA, 1701 nt, Artificial Sequence
  derived and/or modified CDS sequence (AUadapt) from InfluenzaA__ALA08488__HA
augaagaccaucaucgcccugucguacauccucugccugguguucgcccagaagauccccggcaacgggaacuccaccgcgacgcugugccucggccaccacgccgucccgaacgggaccaucgugaagaccaucaccaacgaccgcaucgaggugacgaacgccaccgagcugguccagaacagcuccaucggcgagaucugcgacucgccccaccagauccuggacggggagaacugcacccucaucgacgcccugcugggcgacccccagugcgacggcuuccagaacaagaagugggaccucuucguggagcgguccaaggccuacagcaacugcuaccccuacgacgugccggacuacgcgucccugcgcucgcuggucgccuccagcgggacccucgaguucaacaacgaguccuucaacuggacgggcgugacccagaacgggaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucgggccgcaucaccgugagcacgaagcggucccagcaggccgugaucccgaacaucggcucgcgcccccggauccgcgacauccccucccggaucagcaucuacuggaccaucgucaagcccggggacauccugcugaucaacuccaccggcaaccucaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagucgacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 13226 - RNA, 1701 nt, Artificial Sequence
  derived and/or modified CDS sequence (AUadapt) from InfluenzaA__ALA08490__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggaucgagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13227 - RNA, 1701 nt, Artificial Sequence
  derived and/or modified CDS sequence (AUadapt) from InfluenzaA__ALA08491__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacaugaccaugcccaacaacgagcaguucgacaagcucuacaucuggggcgugcaccaccccgggacggacaaggaccagaucuuccuguacgcccagagcuccggccggaucaccgucucgaccaagcgcagccagcaggccgugaucccgaacaucggcucccggccccgcauccggaacauccccucgcgcaucuccaucuacuggaccaucgugaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgucaaccgcaucaccuacggcgcgugcccccgguacgugaagcaguccacccugaagcucgccacggggaugcgcaacgugcccgagaagcagacccggggcaucuucggggccaucgccggcuucaucgagaacggcugggaggggaugaaggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggaggucgaggggcggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacgucuaccgggacgaggcccucaacaaccgcuuccagaucaagggcguggagcucaagucgggcuacaaggacuggauccuguggaucuccuucgccaucagcugcuuccugcugugcguggcccugcucggguucaucaugugggcgugccagaagggcaacauccggugcaacaucugcaucuga

SEQ ID NO: 13228 - RNA, 1701 nt, Artificial Sequence; identical to SEQ ID NO: 13226
  derived and/or modified CDS sequence (AUadapt) from InfluenzaA__ALA08492__HA

SEQ ID NO: 13229 - RNA, 1701 nt, Artificial Sequence
  derived and/or modified CDS sequence (AUadapt) from InfluenzaA__ALA08493__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugccggucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaaggggaucgagcucaaguccggcuacaaggacuggauccuguggaucagcuucgccaucagcugcuuccugcucugcgucgcccugcugggcuucaucaugugggccugccagaaggggaacauccggugcaacaucugcaucuga

SEQ ID NO: 13230 - RNA, 1701 nt, Artificial Sequence
  derived and/or modified CDS sequence (AUadapt) from InfluenzaA__ALA08494__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagggcucccagcaggccgugaucccgaacaucggcucgcggccccgcauccgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13231 - RNA, 1701 nt, Artificial Sequence; identical to SEQ ID NO: 13230
  derived and/or modified CDS sequence (AUadapt) from InfluenzaA__ALA08495__HA

SEQ ID NO: 13232 - RNA, 1701 nt, Artificial Sequence; identical to SEQ ID NO: 13230
  derived and/or modified CDS sequence (AUadapt) from InfluenzaA__ALA08496__HA

SEQ ID NO: 13233 - RNA, 1701 nt, Artificial Sequence; identical to SEQ ID NO: 68
  derived and/or modified CDS sequence (AUadapt) from InfluenzaA__ALA08497__HA

SEQ ID NO: 13234 - RNA, 1701 nt, Artificial Sequence; identical to SEQ ID NO: 68
  derived and/or modified CDS sequence (AUadapt) from InfluenzaA__ALA08498__HA

SEQ ID NO: 13235 - RNA, 1701 nt, Artificial Sequence
  derived and/or modified CDS sequence (AUadapt) from InfluenzaA__ALA08499__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccgggacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaaggucgaccugugguccuacaacgccgagcugcucguggcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 13236 - RNA, 1701 nt, Artificial Sequence; identical to SEQ ID NO: 13219
  derived and/or modified CDS sequence (AUadapt) from InfluenzaA__ALA08501__HA

SEQ ID NO: 13237 - RNA, 1701 nt, Artificial Sequence
  derived and/or modified CDS sequence (AUadapt) from InfluenzaA__ALA08502__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaaggucgaccugugguccuacaacgccgagcugcucguggcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 13238 - RNA, 1701 nt, Artificial Sequence; identical to SEQ ID NO: 13237
  derived and/or modified CDS sequence (AUadapt) from InfluenzaA__ALA08503__HA

SEQ ID NO: 13239 - RNA, 1701 nt, Artificial Sequence; identical to SEQ ID NO: 68
  derived and/or modified CDS sequence (AUadapt) from InfluenzaA__ALA08504__HA

SEQ ID NO: 13240 - RNA, 1701 nt, Artificial Sequence; identical to SEQ ID NO: 68
  derived and/or modified CDS sequence (AUadapt) from InfluenzaA__ALA08505__HA

SEQ ID NO: 13241 - RNA, 1701 nt, Artificial Sequence; identical to SEQ ID NO: 68
  derived and/or modified CDS sequence (AUadapt) from InfluenzaA__ALA08506__HA

SEQ ID NO: 13242 - RNA, 1701 nt, Artificial Sequence; identical to SEQ ID NO: 68
  derived and/or modified CDS sequence (AUadapt) from InfluenzaA__ALA08507__HA

SEQ ID NO: 13243 - RNA, 1701 nt, Artificial Sequence
  derived and/or modified CDS sequence (AUadapt) from InfluenzaA__ALA08508__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13244 - RNA, 1701 nt, Artificial Sequence; identical to SEQ ID NO: 68
  derived and/or modified CDS sequence (AUadapt) from InfluenzaA__ALA08509__HA

SEQ ID NO: 13245 - RNA, 1701 nt, Artificial Sequence; identical to SEQ ID NO: 68
  derived and/or modified CDS sequence (AUadapt) from InfluenzaA__ALA08510__HA

SEQ ID NO: 13246 - RNA, 1701 nt, Artificial Sequence
  derived and/or modified CDS sequence (AUadapt) from InfluenzaA__ALA08511__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccagcuccucgugcauccggcgcuccagcuccucguucuucucccggcugaacuggcugacccaccucaacuacacguaccccgcccugaacgugaccaugcccaacaacgagcaguucgacaagcuguacaucuggggcguccaccaccccagcaccgacaaggaccagaucuuccucuacgcccagagcuccgggcgcaucaccgugucgacgaagcggucccagcaggcggugaucccgaacaucgggagccgcccccggauccgcgacauccccucccggaucucgaucuacuggaccaucgucaagcccggcgacauccugcugaucaacuccaccggcaaccucaucgccccgcgcggguacuucaagauccggagcggcaaguccucgaucaugcgcuccgacgcccccaucgggaagugcaagagcgagugcaucacccccaacggcuccauccccaacgacaagccguuccagaacgugaaccggaucacguacggcgccugcccccgcuacgugaagcacagcacccugaagcuggccaccgggaugcggaacguccccgagaagcagacccgcggcaucuucggggcgaucgccggcuucaucgagaacgggugggagggcaugguggacggcugguacggguuccggcaccagaacuccgagggccgcgggcaggccgccgaccucaagucgacgcaggccgcgaucgaccagaucaacggcaagcugaaccggcugaucgggaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgccugcaucggcucgauccggaacgggaccuacgaccacaacguguaccgcgacgaggcgcugaacaaccgguuccagaucaagggcgucgagcucaagagcggguacaaggacuggauccuguggaucuccuucgccaucagcugcuuccugcucugcguggcccugcugggcuucaucaugugggccugccagaagggcaacauccgcugcaacaucugcaucuga

SEQ ID NO: 13247 - RNA, 1701 nt, Artificial Sequence; identical to SEQ ID NO: 68
  derived and/or modified CDS sequence (AUadapt) from InfluenzaA__ALA08512__HA

SEQ ID NO: 13248 - RNA, 1701 nt, Artificial Sequence; identical to SEQ ID NO: 68
  derived and/or modified CDS sequence (AUadapt) from InfluenzaA__ALA08514__HA

SEQ ID NO: 13249 - RNA, 1701 nt, Artificial Sequence; identical to SEQ ID NO: 68
  derived and/or modified CDS sequence (AUadapt) from InfluenzaA__ALA08515__HA

SEQ ID NO: 13250 - RNA, 1701 nt, Artificial Sequence; identical to SEQ ID NO: 68
  derived and/or modified CDS sequence (AUadapt) from InfluenzaA__ALA08516__HA

SEQ ID NO: 13251 - RNA, 1701 nt, Artificial Sequence; identical to SEQ ID NO: 13243
  derived and/or modified CDS sequence (AUadapt) from InfluenzaA__ALA08517__HA

SEQ ID NO: 13252 - RNA, 1701 nt, Artificial Sequence; identical to SEQ ID NO: 68
  derived and/or modified CDS sequence (AUadapt) from InfluenzaA__ALA08519__HA

SEQ ID NO: 13253 - RNA, 1701 nt, Artificial Sequence
  derived and/or modified CDS sequence (AUadapt) from InfluenzaA__ALA08520__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagccguccgggcgcaucaccgugagcacgaagcggucgcagcaggccgugauccccaacaucggcucccgcccccggauccgcgacauccccagccggaucuccaucuacuggaccaucgucaagccgggcgacauccugcugaucaacucgaccgggaaccucaucgcgccccgcggcuacuucaagauccggaacgggaaguccagcaucaugcgcuccgacgcccccaucggcaagugcaagucggagugcaucacccccaacggcuccaucccgaacgacaagcccuuccagaacgugaaccggaucacguacggggccugcccccgcuacgugaagcacagcacccugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13254 - RNA, 1701 nt, Artificial Sequence; identical to SEQ ID NO: 10383
  derived and/or modified CDS sequence (AUadapt) from InfluenzaA__ALA08522__HA

SEQ ID NO: 13255 - RNA, 1701 nt, Artificial Sequence
  derived and/or modified CDS sequence (AUadapt) from InfluenzaA__ALA08523__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaucgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13256 - RNA, 1701 nt, Artificial Sequence
  derived and/or modified CDS sequence (AUadapt) from InfluenzaA__ALA08524__HA
augaagaccaucaucgcccugucguacauccucugcaugguguucgcccagaagauccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacucgccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcucgcuggucgccuccagcggcacccuggaguucaacaacgaguccuucaacuggacgggggugacccagaacggcaccucguccgccugcauccggcgcagcuccagcuccuucuucucgcggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccagcgggcgcaucaccgugucgacgaagcggucccagcaggccgugaucccgaacaucggcagccgccuccggauccgcgacauccccucccggaucucgaucuacuggaccaucgucaagcccggcgacauccugcugaucaacuccaccgggaaccucaucgcgccccgcggcuacuucaagauccggagcgggaaguccagcaucaugcgcuccgacgccccgaucggcaagugcaagucggagugcaucacccccaacggcuccauccccaacgacaagcccuuccagaacgugaaccggaucacguacggggccugcccgcgcuacgugaagcacagcacccugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13257 - RNA, 1701 nt, Artificial Sequence; identical to SEQ ID NO: 68
  derived and/or modified CDS sequence (AUadapt) from InfluenzaA__ALA08525__HA

SEQ ID NO: 13258 - RNA, 1701 nt, Artificial Sequence; identical to SEQ ID NO: 68
  derived and/or modified CDS sequence (AUadapt) from InfluenzaA__ALA08526__HA

SEQ ID NO: 13259 - RNA, 1701 nt, Artificial Sequence; identical to SEQ ID NO: 13243
  derived and/or modified CDS sequence (AUadapt) from InfluenzaA__ALA08527__HA

SEQ ID NO: 13260 - RNA, 1701 nt, Artificial Sequence
  derived and/or modified CDS sequence (AUadapt) from InfluenzaA__ALA08528__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccucggaccgcaucgaggugacgaacgccaccgagcugguccagaacuccagcaucggcgagaucugcgacucgccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgucgcugcgcucccucgucgccagcuccggcacccuggaguucaacgacgagucguucaacugggccggcgugacgcagaacgggaccuccagcgccugcauccggggcuccaacucguccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuaccucuacgcccagucgagcgggcggaucaccguguccaccaagcgcucgcagcaggccgugaucccgaacaucggcucccggccccgcauccggaacauccccagccgcaucuccaucuacuggaccaucgucaagcccggcgacauccugcugaucaacucgacggggaaccucaucgccccgcggggcuacuucaagauccgcuccgggaaguccuccaucaugcggagcgacgcccccaucggcaagugcaaguccgagugcaucacccccaacggcucgauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucucggagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagaugcgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagucgggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 13261 - RNA, 1701 nt, Artificial Sequence; identical to SEQ ID NO: 68
  derived and/or modified CDS sequence (AUadapt) from InfluenzaA__ALA08529__HA

SEQ ID NO: 13262 - RNA, 1701 nt, Artificial Sequence; identical to SEQ ID NO: 68
  derived and/or modified CDS sequence (AUadapt) from InfluenzaA__ALA08530__HA

SEQ ID NO: 13263 - RNA, 1701 nt, Artificial Sequence
  derived and/or modified CDS sequence (AUadapt) from InfluenzaA__ALA08531__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacaaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13264 - RNA, 1701 nt, Artificial Sequence; identical to SEQ ID NO: 68
  derived and/or modified CDS sequence (AUadapt) from InfluenzaA__ALA08532__HA

SEQ ID NO: 13265 - RNA, 1701 nt, Artificial Sequence; identical to SEQ ID NO: 68
  derived and/or modified CDS sequence (AUadapt) from InfluenzaA__ALA08533__HA

SEQ ID NO: 13266 - RNA, 1701 nt, Artificial Sequence; identical to SEQ ID NO: 68
  derived and/or modified CDS sequence (AUadapt) from InfluenzaA__ALA08534__HA

SEQ ID NO: 13267 - RNA, 1701 nt, Artificial Sequence; identical to SEQ ID NO: 68
  derived and/or modified CDS sequence (AUadapt) from InfluenzaA__ALA08535__HA

SEQ ID NO: 13268 - RNA, 1701 nt, Artificial Sequence; identical to SEQ ID NO: 13243
  derived and/or modified CDS sequence (AUadapt) from InfluenzaA__ALA08536__HA

SEQ ID NO: 13269 - RNA, 1701 nt, Artificial Sequence; identical to SEQ ID NO: 13243
  derived and/or modified CDS sequence (AUadapt) from InfluenzaA__ALA08537__HA

SEQ ID NO: 13270 - RNA, 1701 nt, Artificial Sequence; identical to SEQ ID NO: 13243
  derived and/or modified CDS sequence (AUadapt) from InfluenzaA__ALA08538__HA

SEQ ID NO: 13271 - RNA, 1701 nt, Artificial Sequence; identical to SEQ ID NO: 68
  derived and/or modified CDS sequence (AUadapt) from InfluenzaA__ALA08539__HA

SEQ ID NO: 13272 - RNA, 1701 nt, Artificial Sequence; identical to SEQ ID NO: 13243
  derived and/or modified CDS sequence (AUadapt) from InfluenzaA__ALA08540__HA

SEQ ID NO: 13273 - RNA, 1701 nt, Artificial Sequence; identical to SEQ ID NO: 13243
  derived and/or modified CDS sequence (AUadapt) from InfluenzaA__ALA08541__HA

SEQ ID NO: 13274 - RNA, 1701 nt, Artificial Sequence; identical to SEQ ID NO: 13243
  derived and/or modified CDS sequence (AUadapt) from InfluenzaA__ALA08542__HA

SEQ ID NO: 13275 - RNA, 1701 nt, Artificial Sequence
  derived and/or modified CDS sequence (AUadapt) from InfluenzaA__ALA08543__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgccaucccgaacaucggcagccgcccccggauccgcgacauccccucccggaucucgaucuacuggaccaucgugaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgucaaccggaucacguacggggcgugcccccgcuacgugaagcacucgacccugaagcuggccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggucguacaacgccgagcugcucgucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaaggggguggagcucaaguccggcuacaaggacuggauccuguggaucucguucgccaucagcugcuuccugcucugcgucgcccugcugggcuucaucaugugggcgugccagaaggggaacauccgcugcaacaucugcaucuga

SEQ ID NO: 13276 - RNA, 1701 nt, Artificial Sequence; identical to SEQ ID NO: 68
  derived and/or modified CDS sequence (AUadapt) from InfluenzaA__ALA08545__HA

SEQ ID NO: 13277 - RNA, 1701 nt, Artificial Sequence; identical to SEQ ID NO: 68
  derived and/or modified CDS sequence (AUadapt) from InfluenzaA__ALA08546__HA

SEQ ID NO: 13278 - RNA, 1701 nt, Artificial Sequence
  derived and/or modified CDS sequence (AUadapt) from InfluenzaA__ALA08548__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcguggcccagaacgggacguccucggcgugcauccggggcuccaacagcuccuucuucucgcgccugaacuggcucacccacuccaacuucaaguaccccgcccugaacgugaccaugcccaacaacgagcaguucgacaagcuguacaucuggggcguccaccaccccgggaccgacaaggaccagaucuuccucuacgcccagagcucggggcggaucacgguguccaccaagcgcagccagcaggccgugaucccgaacaucggcucccggccccgcauccggaacauccccucgcgcaucuccaucuacuggaccaucgucaagcccggcgacauccugcugaucaacagcaccgggaaccucaucgccccgcggggcuacuucaagauccgcuccgggaaguccuccaucaugcggucggacgcgcccaucggcaagugcaaguccgagugcaucacgcccaacggcagcauccccaacgacaagccguuccagaacgugaaccgcaucaccuacggggccugcccccgguacgugaagcaguccacccugaagcuggccaccggcaugcgcaacguccccgagaagcagacgcgggggaucuucggcgccaucgccggguucaucgagaacggcugggagggcaugaaggacgggugguacggcuuccgccaccagaacucggaggggcggggccaggcggccgaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacaccaagaucgaccugugguccuacaacgccgagcugcucgucgcgcuggagaaccagcacacgaucgaccugaccgacucggagaugaacaagcuguucgagaagaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucagcuucgccaucuccugcuuccugcucugcgucgcgcugcugggcuucaucaugugggccugccagaaggggaacauccggugcaacaucugcaucuga

SEQ ID NO: 13279 - RNA, 1701 nt, Artificial Sequence
  derived and/or modified CDS sequence (AUadapt) from InfluenzaA__ALA08549__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaccggggugaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcucgcugguggccuccagcggcacgcucgaguucaacaacgaguccuucaacuggaccggggugacccagaacggcaccucguccgccugcauccggcgcagcuccucguccuucuucagccggcugaacuggcugacgcaccucaacuacaccuaccccgcccugaacgucaccaugcccaacaacgagcaguucgacaagcuguacaucuggggcgugcaccaccccgggaccgacaaggaccagaucuuccucuacgcgcaguccucggggcgcaucacggugagcaccaagggcucccagcaggccgucaucccgaacaucggcucgcggccccgcauccgggacauccccucccgcaucagcaucuacuggaccaucgugaagcccggggacauccugcugaucaacuccaccggcaaccucaucgccccgcggggguacuucaagauccgcucgggcaaguccagcaucaugcgguccgacgcccccaucggcaagugcaagucggagugcaucacgcccaacggguccauccccaacgacaagccguuccagaacgugaaccgcaucaccuacggcgccugcccccgguacgucaagcacagcacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacacgaucgaccugaccgacuccgagaugaacaagcuguucgagaagacccgcaagcagcuccgcgagaacgccgaggacaugggcaacgggugcuucaagaucuaccacaagugcgacaacgcgugcaucggcucgauccggaacgggaccuacgaccacaacgucuaccgcgacgaggcccugaacaaccgguuccagaucaagggcguggagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 13280 - RNA, 1701 nt, Artificial Sequence; identical to SEQ ID NO: 13243
  derived and/or modified CDS sequence (AUadapt) from InfluenzaA__ALA08550__HA

SEQ ID NO: 13281 - RNA, 1701 nt, Artificial Sequence
  derived and/or modified CDS sequence (AUadapt) from InfluenzaA__ALA08551__HA
augaagaccaucaucgcccugucguacauccucugccugguguucgcccagaagcugcucgagaacgacaacuccaccgcgacgcugugccugggccaccacgccguccccaacgggaccaucgugaagaccaucaccagcgaccgcaucgaggugacgaacgccaccgagcucguccagaacuccucgaucggcgagaucugcgacuccccgcaccagauccuggacgggaagaacugcacccugaucgacgcccuccugggcgacccccagugcgacggguuccagaacaagaagugggaccuguucguggagcggagcaaggccuacuccaacugcuaccccuacgacgugcccgacuacgcgucgcuccgcucccuggucgccagcuccggcacccuggaguucaacgacgagucguucaacugggccggcgugacgcagaacgggaccuccagcgccugcauccggggcuccaacagcuccuucuucucgcgccucaacuggcugacccacuccaacuucaaguacccggcgcugaacgugaccaugcccaacaacgagcaguucgacaagcucuacaucuggggcguccaccaccccgggacggacaaggaccagaucuuccuguacgcccagagcucggggcggaucaccguguccaccaagcgcagccagcaggccgugauccccaacaucggcucccggccgcgcauccggaacauccccucgcgcaucuccaucuacuggaccaucgucaagcccggcgacauccugcucaucaacagcacggggaaccugaucgcgccccggggcuacuucaagauccgcuccggcaagagcuccaucaugcggucggacgccccgaucgggaagugcaaguccgagugcaucacccccaacggcagcauccccaacgacaagcccuuccagaacgugaaccgcaucaccuacggggccugcccgcgguacgugaagcaguccacccugaagcucgccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacguggaggacacgaagaucgaccugugguccuacaacgccgagcuccuggucgcccuggagaaccagcacaccaucgaccucaccgacucggagaugaacaagcuguucgagaagaccaagaagcagcugcgcgagaacgcggaggacauggggaacggcugcuucaagaucuaccacaagugcgacaacgccugcaucggguccauccgcaacggcacguacgaccacaacguguaccgggacgaggcccucaacaaccgcuuccagaucaaggggguggagcucaagagcggcuacaaggacuggauccuguggaucagcuucgccaucuccugcuuccugcugugcgucgcccugcucggcuucaucaugugggcgugccagaaggggaacauccggugcaacaucugcaucuga

SEQ ID NO: 13282 - RNA, 1701 nt, Artificial Sequence; identical to SEQ ID NO: 13243
  derived and/or modified CDS sequence (AUadapt) from InfluenzaA__ALA08552__HA

SEQ ID NO: 13283 - RNA, 1701 nt, Artificial Sequence; identical to SEQ ID NO: 13243
  derived and/or modified CDS sequence (AUadapt) from InfluenzaA__ALA08553__HA

SEQ ID NO: 13284 - RNA, 1701 nt, Artificial Sequence
  derived and/or modified CDS sequence (AUadapt) from InfluenzaA__ALA08554__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucauguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13285 - RNA, 1701 nt, Artificial Sequence
  derived and/or modified CDS sequence (AUadapt) from InfluenzaA__ALA08555__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccagaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcgcuccaaggccuacuccaacugcuaccccuacgacgugccggacuacgcgucgcugcggucccucgucgccagcuccggcacccuggaguucaacgacgagucguucaacugggccggcgugacgcagaacgggaccuccagcgccugcauccgcggcuccaacucguccuucuucagccggcugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagucgagcgggcgcaucaccguguccaccaagcggagccagcaggccgugaucccguccaucggcucgcgcccccggauccgcaacauccccucccggaucagcaucuacuggaccaucgucaagcccggcgacauccugcugaucaacuccacggggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggcgugcccccgcuacgugaagcagagcacccugaagcuggccacgggcaugcggaacguccccgagaagcagacccgcgggaucuucggcgccaucgccggguucaucgagaacggcugggagggcaugaaggacgggugguacggcuuccggcaccagaacuccgaggggcgcggccaggccgcggaccucaagucgacccaggccgccaucgaccagaucaacgggaagcugaaccggcugaucggcaagaccaacgagaaguuccaccagaucgagaaggaguucuccgagguggagggccgcauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgggagaacgcggaggacauggggaacggcugcuucaagaucuaccacaagugcgacaacgccugcaucgggucgauccgcaacggcacguacgaccacaacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggcgugccagaaggggaacauccgcugcaacaucugcaucuga

SEQ ID NO: 13286 - RNA, 1701 nt, Artificial Sequence
  derived and/or modified CDS sequence (AUadapt) from InfluenzaA__ALA08556__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacggggaucacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccucggggcgcaucaccgucagcacgaagcggucccagcaggccgugaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13287 - RNA, 1701 nt, Artificial Sequence; identical to SEQ ID NO: 13243
  derived and/or modified CDS sequence (AUadapt) from InfluenzaA__ALA08557__HA

SEQ ID NO: 13288 - RNA, 1701 nt, Artificial Sequence; identical to SEQ ID NO: 13243
  derived and/or modified CDS sequence (AUadapt) from InfluenzaA__ALA08558__HA

SEQ ID NO: 13289 - RNA, 1701 nt, Artificial Sequence
  derived and/or modified CDS sequence (AUadapt) from InfluenzaA__ALA08559__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccucggggcggaucaccgugagcacgaagggcucccagcaggccgugaucccgaacaucggcucgcgcccccggauccgcgacauccccucccggaucagcaucuacuggaccaucgucaagcccggggacauccugcugaucaacuccgccggcaaccucaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucaccuacggcgcgugcccccgcuacgugaagcacagcacgcugaagcuggccaccgggaugcggaacguccccgagaagcagacccgcggcaucuucggggccaucgccggcuucaucgagaacggcugggaggggaugguggacggcugguacggguuccggcaccagaacuccgagggccgcgggcaggccgcggaccucaagucgacccaggccgccaucgaccagaucaacggcaagcugaaccggcugaucggcaagacgaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcucgauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggcgugccagaagggcaacauccgcugcaacaucugcaucuga

SEQ ID NO: 13290 - RNA, 1701 nt, Artificial Sequence; identical to SEQ ID NO: 68
  derived and/or modified CDS sequence (AUadapt) from InfluenzaA__ALA08560__HA

SEQ ID NO: 13291 - RNA, 1701 nt, Artificial Sequence
  derived and/or modified CDS sequence (AUadapt) from InfluenzaA__ALA08561__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaaggagcaguucgacaagcuguacaucuggggcguccaccaccccgggaccgacaaggaccagaucuuccucuacgcgcaguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13292 - RNA, 1701 nt, Artificial Sequence
  derived and/or modified CDS sequence (AUadapt) from InfluenzaA__ALA08563__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccugagcgggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 13293 - RNA, 1701 nt, Artificial Sequence
  derived and/or modified CDS sequence (AUadapt) from InfluenzaA__ALA08571__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaccagcugcuuccugcucugcguggcccugcugggcuucaucaugugggccugccagaaggggaacauccgcugcaacaucugcaucuga

SEQ ID NO: 13294 - RNA, 1701 nt, Artificial Sequence; identical to SEQ ID NO: 13229
  derived and/or modified CDS sequence (AUadapt) from InfluenzaA__ALA08572__HA

SEQ ID NO: 13295 - RNA, 1701 nt, Artificial Sequence; identical to SEQ ID NO: 13226
  derived and/or modified CDS sequence (AUadapt) from InfluenzaA__ALA08573__HA

SEQ ID NO: 13296 - RNA, 1701 nt, Artificial Sequence
  derived and/or modified CDS sequence (AUadapt) from InfluenzaA__ALA08574__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucuccgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13297 - RNA, 1701 nt, Artificial Sequence
  derived and/or modified CDS sequence (AUadapt) from InfluenzaA__ALA08575__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcagagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13298 - RNA, 1701 nt, Artificial Sequence; identical to SEQ ID NO: 68
  derived and/or modified CDS sequence (AUadapt) from InfluenzaA__ALA08576__HA

SEQ ID NO: 13299 - RNA, 1701 nt, Artificial Sequence; identical to SEQ ID NO: 68
  derived and/or modified CDS sequence (AUadapt) from InfluenzaA__ALA08577__HA

SEQ ID NO: 13300 - RNA, 1701 nt, Artificial Sequence
  derived and/or modified CDS sequence (AUadapt) from InfluenzaA__ALA08579__HA
augaagaccaucaucgcccugucguacauccucugccugaucuucgcccagaagauccccggcaacgacaacuccaccgcgacgcugugccucgggcaccacgccgugccgaacggcaccaucgucaagaccaucaccaacgaccgcaucgaggugacgaacgccaccgagcuggugcagaacagcuccaucggggagaucugcgacucgccccaccagauccuggacggcgagaacugcacccucaucgacgcccugcugggggacccccagugcgacggcuuccagaacaagaagugggaccucuucgucgagcgguccaaggccuacagcaacugcuaccccuacgacgugccggacuacgcgucccugcgcucgcugguggccuccagcggcacccucgaguucaacaacgaguccuucaacuggacgggggucacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcgguccucggggcgcaucaccgucagcacgaagcggucccagcaggccgugaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13301 - RNA, 1701 nt, Artificial Sequence
  derived and/or modified CDS sequence (AUadapt) from InfluenzaA__ALA08580__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccucggggcggaucaccgugagcacgaagggcucccagcaggccgugaucccgaacaucggcucgcgcccccggauccgcgacauccccucccggaucagcaucuacuggaccaucgucaagcccggggacauccugcugaucaacuccaccggcaaccucaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagucgacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 13302 - RNA, 1701 nt, Artificial Sequence
  derived and/or modified CDS sequence (AUadapt) from InfluenzaA__ALA08582__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccgcaucgaggugacgaacgccaccgagcugguccagaacucguccaucggcgagaucugcgacagcccccaccagauccucgacgggaagaacugcacccugaucgacgcccugcucggcgacccccagugcgacggguuccagaacaagaagugggaccuguucguggagcgguccaaggccuacucgaacugcuaccccuacgacgugccggacuacgcgucccugcgcagccucgucgccuccucgggcacccuggaguucaacgacgaguccuucaacugggccggcgugacgcagaacgggaccagcuccgccugcauccggggcucgaacuccagcuucuucucccgccugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccaguccagcgggcggaucaccgugucgaccaagcgcucccagcaggccgugaucccgaacaucggcagccggccccgcauccggaacauccccucccgcaucucgaucuacuggaccaucgucaagcccggcgacauccugcugaucaacuccacggggaaccucaucgccccgcggggcuacuucaagauccgcagcgggaaguccucgaucaugcgguccgacgcccccaucggcaagugcaagagcgagugcaucacccccaacggcuccauccccaacgacaagccguuccagaacgugaaccgcaucaccuacggggcgugcccccgguacgugaagcagucgacccugaagcuggccacgggcaugcgcaacguccccgagaagcagacccgggggaucuucggcgccaucgccggguucaucgagaacggcugggagggcaugaaggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccucgagaaguacguggaggacacgaagaucgaccuguggucguacaacgccgagcugcucgucgcccuggagaaccagcacaccaucgaccugaccgacuccgagaugaacaagcuguucgagaagaccaagaagcagcuccgcgagaacgcggaggacauggggaacggcugcuucaagaucuaccacaagugcgacaacgccugcaucgggagcauccgcaacggcacguacgaccacgacguguaccgggacgaggcccugaacaaccgcuuccagaucaaggggguggagcucaaguccggcuacaaggacuggauccuguggaucucguucgccaucagcugcuuccugcucugcgucgcccugcugggcuucaucaugugggcgugccagaaggggaacauccggugcaacaucugcaucuga

SEQ ID NO: 13303 - RNA, 1701 nt, Artificial Sequence; identical to SEQ ID NO: 13302
  derived and/or modified CDS sequence (AUadapt) from InfluenzaA__ALA08583__HA

SEQ ID NO: 13304 - RNA, 1701 nt, Artificial Sequence; identical to SEQ ID NO: 13302
  derived and/or modified CDS sequence (AUadapt) from InfluenzaA__ALA08584__HA

SEQ ID NO: 13305 - RNA, 1701 nt, Artificial Sequence; identical to SEQ ID NO: 13302
  derived and/or modified CDS sequence (AUadapt) from InfluenzaA__ALA08585__HA

SEQ ID NO: 13306 - RNA, 1701 nt, Artificial Sequence; identical to SEQ ID NO: 68
  derived and/or modified CDS sequence (AUadapt) from InfluenzaA__ALA08586__HA

SEQ ID NO: 13307 - RNA, 1701 nt, Artificial Sequence; identical to SEQ ID NO: 13302
  derived and/or modified CDS sequence (AUadapt) from InfluenzaA__ALA08587__HA

SEQ ID NO: 13308 - RNA, 1701 nt, Artificial Sequence; identical to SEQ ID NO: 68
  derived and/or modified CDS sequence (AUadapt) from InfluenzaA__ALA08588__HA

SEQ ID NO: 13309 - RNA, 1701 nt, Artificial Sequence; identical to SEQ ID NO: 68
  derived and/or modified CDS sequence (AUadapt) from InfluenzaA__ALA08589__HA

SEQ ID NO: 13310 - RNA, 1701 nt, Artificial Sequence; identical to SEQ ID NO: 13302
  derived and/or modified CDS sequence (AUadapt) from InfluenzaA__ALA08590__HA

SEQ ID NO: 13311 - RNA, 1701 nt, Artificial Sequence; identical to SEQ ID NO: 68
  derived and/or modified CDS sequence (AUadapt) from InfluenzaA__ALA08591__HA

SEQ ID NO: 13312 - RNA, 1701 nt, Artificial Sequence; identical to SEQ ID NO: 13243
  derived and/or modified CDS sequence (AUadapt) from InfluenzaA__ALA08592__HA

SEQ ID NO: 13313 - RNA, 1701 nt, Artificial Sequence
  derived and/or modified CDS sequence (AUadapt) from InfluenzaA__ALA08594__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccauguccugcuuccugcucugcgucgcccugcugggcuucaucaugugggcgugccagaaggggaacauccggugcaacaucugcaucuga

SEQ ID NO: 13314 - RNA, 1701 nt, Artificial Sequence; identical to SEQ ID NO: 68
  derived and/or modified CDS sequence (AUadapt) from InfluenzaA__ALA08595__HA

SEQ ID NO: 13315 - RNA, 1701 nt, Artificial Sequence; identical to SEQ ID NO: 68
  derived and/or modified CDS sequence (AUadapt) from InfluenzaA__ALA08596__HA

SEQ ID NO: 13316 - RNA, 1701 nt, Artificial Sequence
  derived and/or modified CDS sequence (AUadapt) from InfluenzaA__ALA08597__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaacgggaacauccgcugcaacaucugcaucuga

SEQ ID NO: 13317 - RNA, 1701 nt, Artificial Sequence
  derived and/or modified CDS sequence (AUadapt) from InfluenzaA__ALA08598__HA
augaagaccaucaucgccucguccuacauccugugccucguguucgcccagaagauccccggcaacgacaacagcaccgcgacgcugugccuggggcaccacgccgucccgaacggcaccaucgugaagaccaucaccaacgaccgcaucgaggugacgaacgccaccgagcucguccagaacuccucgaucggggagaucugcgacagcccccaccagauccuggacggcgagaacugcacccugaucgacgcccuccugggggacccccagugcgacggcuuccagaacaagaagugggaccuguucguggagcggucgaaggccuacuccaacugcuaccccuacgacgugccggacuacgcgagccuccgcucccuggucgccucguccggcacccuggaguucaacaacgagagcuucaacuggacgggggugacccagaacggcaccuccucggccugcauccggcgcuccagcuccucguucuucucccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcagagcucggggcgcaucaccguguccacgaagcggagccagcaggccgugaucccgaacaucggcucccgcccccggauccgcgacauccccucgcggaucuccaucuacuggaccaucgucaagcccggcgacauccuccugaucaacagcaccgggaaccugaucgccccgcgcggcuacuucaagauccgguccgggaaguccuccaucaugcgcucggacgcccccaucggcaagugcaaguccgagugcaucacccccaacggcagcauccccaacgacaagccguuccagaacgugaaccggaucacguacggggccugcccccgcuacgugaagcacuccacccucaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccugaaguccacgcaggcggccaucgaccagaucaacgggaagcucaaccggcugaucggcaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcugugcguggcccuccugggcuucaucaugugggccugccagaaggggaacauccgcugcaacaucugcaucuga

SEQ ID NO: 13318 - RNA, 1701 nt, Artificial Sequence; identical to SEQ ID NO: 68
  derived and/or modified CDS sequence (AUadapt) from InfluenzaA__ALA08599__HA

SEQ ID NO: 13319 - RNA, 1701 nt, Artificial Sequence
  derived and/or modified CDS sequence (AUadapt) from InfluenzaA__ALA08600__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuaccgcuaccccgcccugaacgugacgaugcccaacaacgagcaguucgacaagcuguacaucuggggcguccaccaccccgggaccgacaaggaccagaucucccucuacgcgcagagcucggggcggaucaccguguccaccaagcgcagccagcaggccgugaucccgaacaucggcucccggccccgcauccgggacauccccucgcgcaucuccaucuacuggacgaucgucaagcccggcgacauccugcugaucaacagcaccgggaaccucaucgccccgcggggcuacuucaagauccgcuccggcaagucguccaucaugcggagcgacgcccccaucgggaagugcaaguccgagugcaucacccccaacggcucgauccccaacgacaagccguuccagaacgugaaccgcaucaccuacggggccugcccccgguacgugaagcacuccacgcugaagcuggcgaccggcaugcgcaacguccccgagaagcagacccgggggaucuucggcgccaucgccggguucaucgagaacggcugggagggcaugguggacgggugguacggcuuccgccaccagaacagcgaggggcggggccaggccgccgaccucaaguccacccaggcggccaucgaccagaucaacgggaagcugaaccgccugaucggcaagacgaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgggagaacgccgaggacauggggaacggcugcuucaagaucuaccacaagugcgacaacgcgugcaucggguccauccgcaacggcaccuacgaccacaacguguaccgggacgaggcccugaacaaccgcuuccagaucaagggggucgagcucaagucgggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 13320 - RNA, 1701 nt, Artificial Sequence; identical to SEQ ID NO: 68
  derived and/or modified CDS sequence (AUadapt) from InfluenzaA__ALA08601__HA

SEQ ID NO: 13321 - RNA, 1701 nt, Artificial Sequence
  derived and/or modified CDS sequence (AUadapt) from InfluenzaA__ALA08602__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacgacuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggcgugacccagaacgggaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucucccucuacgcgcagagcucgggccgcaucaccguguccacgaagcggagccagcaggccgugaucccgaacaucgggucccgcccccggauccgcgacauccccucgcggaucuccaucuacuggaccaucgucaagcccggcgacauccugcugaucaacagcaccggcaaccucaucgccccgcgcggguacuucaagauccgguccggcaagucguccaucaugcgcagcgacgcccccaucgggaagugcaaguccgagugcaucacccccaacggcucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacgggugggagggcaugguggacggcugguacggguuccggcaccagaacagcgagggccgcgggcaggccgccgaccucaaguccacgcaggcggccaucgaccagaucaacggcaagcugaaccggcugaucgggaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggguacaaggacuggauccuguggaucagcuucgccaucuccugcuuccugcucugcguggcccugcugggcuucaucaugugggccugccagaagggcaacauccgcugcaacaucugcaucuga

SEQ ID NO: 13322 - RNA, 1701 nt, Artificial Sequence
  derived and/or modified CDS sequence (AUadapt) from InfluenzaA__ALA08603__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcaguccagcgggcgcaucaccgugucgaccaagcggucccagcaggccgugaucccgaacaucggcagccgcccccggauccgcgacauccccucccggaucucgaucuacuggacgaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13323 - RNA, 1701 nt, Artificial Sequence; identical to SEQ ID NO: 68
  derived and/or modified CDS sequence (AUadapt) from InfluenzaA__ALA08605__HA

SEQ ID NO: 13324 - RNA, 1701 nt, Artificial Sequence; identical to SEQ ID NO: 68
  derived and/or modified CDS sequence (AUadapt) from InfluenzaA__ALA08606__HA

SEQ ID NO: 13325 - RNA, 1701 nt, Artificial Sequence; identical to SEQ ID NO: 13301
  derived and/or modified CDS sequence (AUadapt) from InfluenzaA__ALA08607__HA

SEQ ID NO: 13326 - RNA, 1701 nt, Artificial Sequence
  derived and/or modified CDS sequence (AUadapt) from InfluenzaA__ALA08609__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgacaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13327 - RNA, 1701 nt, Artificial Sequence; identical to SEQ ID NO: 13243
  derived and/or modified CDS sequence (AUadapt) from InfluenzaA__ALA08610__HA

SEQ ID NO: 13328 - RNA, 1701 nt, Artificial Sequence
  derived and/or modified CDS sequence (AUadapt) from InfluenzaA__ALA08611__HA
augaagaucaucaucgcccugucguacauccucugccugguguucgcccagaagauccccggcaacgacaacuccaccgcgacccugugccucgggcaccacgccgucccgaacggcacgaucgugaagaccaucaccaacgaccgcaucgaggugaccaacgccacggagcugguccagaacagcuccaucggggagaucugcgacucgccccaccggauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggucgcuggucgccuccagcggcacccucgaguucaacaacgaguccuucaacuggaccggggugacgcagaacggcaccucguccgccugcauccgccggagcuccagcuccuucuucucgcgccugaacuggcugacccaccucaacuacaccuaccccgcccugaacgugacgaugcccaacaacgagcaguucgacaagcuguacaucuggggcguccaccaccccgggaccgacaaggaccagaucuuccucuacgcgcaguccagcgggcggaucaccgugucgaccaagcgcucccagcaggccgugaucccgaacaucggcagccggccccgcauccgggacauccccucccgcaucucgaucuacuggacgaucgucaagcccggcgacauccugcugaucaacuccaccgggaaccucaucgccccgcggggcuacuucaagauccgcagcgggaaguccagcaucaugcgguccgacgcccccaucggcaagugcaagucggagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgggagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13329 - RNA, 1701 nt, Artificial Sequence; identical to SEQ ID NO: 13301
  derived and/or modified CDS sequence (AUadapt) from InfluenzaA__ALA08612__HA

SEQ ID NO: 13330 - RNA, 1701 nt, Artificial Sequence; identical to SEQ ID NO: 68
  derived and/or modified CDS sequence (AUadapt) from InfluenzaA__ALA08614__HA

SEQ ID NO: 13331 - RNA, 1701 nt, Artificial Sequence; identical to SEQ ID NO: 68
  derived and/or modified CDS sequence (AUadapt) from InfluenzaA__ALA08615__HA

SEQ ID NO: 13332 - RNA, 1701 nt, Artificial Sequence; identical to SEQ ID NO: 68
  derived and/or modified CDS sequence (AUadapt) from InfluenzaA__ALA08616__HA

SEQ ID NO: 13333 - RNA, 1701 nt, Artificial Sequence; identical to SEQ ID NO: 13226
  derived and/or modified CDS sequence (AUadapt) from InfluenzaA__ALA08617__HA

SEQ ID NO: 13334 - RNA, 1701 nt, Artificial Sequence
  derived and/or modified CDS sequence (AUadapt) from InfluenzaA__ALA08619__HA
augaagaccgugaucgcccugucguacauccucugccuggucuucgcccagaagauccccggcaacgacaacuccaccgcgacgcugugccucgggcaccacgccgugccgaacggcaccaucgugaagaccaucaccaacgaccgcaucgaggucacgaacgccaccgagcuggugcagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcucgcugaucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgagaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaucuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13335 - RNA, 1701 nt, Artificial Sequence; identical to SEQ ID NO: 13301
  derived and/or modified CDS sequence (AUadapt) from InfluenzaA__ALA08620__HA

SEQ ID NO: 13336 - RNA, 1701 nt, Artificial Sequence; identical to SEQ ID NO: 13292
  derived and/or modified CDS sequence (AUadapt) from InfluenzaA__ALA08621__HA

SEQ ID NO: 13337 - RNA, 1701 nt, Artificial Sequence
  derived and/or modified CDS sequence (AUadapt) from InfluenzaA__ALA08622__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13338 - RNA, 1701 nt, Artificial Sequence; identical to SEQ ID NO: 68
  derived and/or modified CDS sequence (AUadapt) from InfluenzaA__ALA08623__HA

SEQ ID NO: 13339 - RNA, 1701 nt, Artificial Sequence; identical to SEQ ID NO: 13292
  derived and/or modified CDS sequence (AUadapt) from InfluenzaA__ALA08624__HA

SEQ ID NO: 13340 - RNA, 1701 nt, Artificial Sequence; identical to SEQ ID NO: 68
  derived and/or modified CDS sequence (AUadapt) from InfluenzaA__ALA08625__HA

SEQ ID NO: 13341 - RNA, 1701 nt, Artificial Sequence; identical to SEQ ID NO: 68
  derived and/or modified CDS sequence (AUadapt) from InfluenzaA__ALA08626__HA

SEQ ID NO: 13342 - RNA, 1701 nt, Artificial Sequence; identical to SEQ ID NO: 68
  derived and/or modified CDS sequence (AUadapt) from InfluenzaA__ALA08627__HA

SEQ ID NO: 13343 - RNA, 1701 nt, Artificial Sequence; identical to SEQ ID NO: 13230
  derived and/or modified CDS sequence (AUadapt) from InfluenzaA__ALA08629__HA

SEQ ID NO: 13344 - RNA, 1701 nt, Artificial Sequence
  derived and/or modified CDS sequence (AUadapt) from InfluenzaA__ALA08630__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13345 - RNA, 1701 nt, Artificial Sequence
  derived and/or modified CDS sequence (AUadapt) from InfluenzaA__ALA08631__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaaggagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13346 - RNA, 1701 nt, Artificial Sequence
  derived and/or modified CDS sequence (AUadapt) from InfluenzaA__ALA08632__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagggcucccagcaggccgugaucccgaacgucggcucgcggccccgcauccgggacauccccucccgcaucagcaucuacuggaccaucgugaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgucaagcacagcacccugaagcuggcgaccgggaugcgcaacgugcccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacgucuaccgggacgaggcccugaacaaccgcuuccagaucaagggcguggagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13347 - RNA, 1701 nt, Artificial Sequence; identical to SEQ ID NO: 13243
  derived and/or modified CDS sequence (AUadapt) from InfluenzaA__ALA08634__HA

SEQ ID NO: 13348 - RNA, 1701 nt, Artificial Sequence; identical to SEQ ID NO: 68
  derived and/or modified CDS sequence (AUadapt) from InfluenzaA__ALA08635__HA

SEQ ID NO: 13349 - RNA, 1701 nt, Artificial Sequence
  derived and/or modified CDS sequence (AUadapt) from InfluenzaA__ALA08636__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucugggggauccaccaccccggcaccgacaaggaccagaucuuccucuacgcgcaguccucggggcgcaucaccgucagcacgaagcggucccagcaggccgugaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13350 - RNA, 1701 nt, Artificial Sequence; identical to SEQ ID NO: 13243
  derived and/or modified CDS sequence (AUadapt) from InfluenzaA__ALA08637__HA

SEQ ID NO: 13351 - RNA, 1701 nt, Artificial Sequence
  derived and/or modified CDS sequence (AUadapt) from InfluenzaA__ALA08638__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcaacuccucguucuucucccgccugaacuggcugacccacagcaacuucaaguaccccgcccucaacgugacgaugcccaacaacgagcaguucgacaagcuguacaucuggggcguccaccaccccgggaccgacaaggaccagaucuuccuguacgcgcaguccucgggccggaucaccgugagcaccaagcgcucccagcaggccgugaucccgaacaucggcucgcggccccgcauccgggacauccccucccgcaucagcaucuacuggacgaucgucaagcccggggacauccuccugaucaacuccaccggcaaccugaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgccugcccccgguacgugaagcacagcacgcucaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagacgaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcugaaguccggcuacaaggacuggauccucuggaucagcuucgccaucagcugcuuccugcugugcguggcccuccugggguucaucaugugggccugccagaagggcaacauccggugcaacaucugcaucuga

SEQ ID NO: 13352 - RNA, 1701 nt, Artificial Sequence; identical to SEQ ID NO: 13243
  derived and/or modified CDS sequence (AUadapt) from InfluenzaA__ALA08639__HA

SEQ ID NO: 13353 - RNA, 1701 nt, Artificial Sequence; identical to SEQ ID NO: 13243
  derived and/or modified CDS sequence (AUadapt) from InfluenzaA__ALA08640__HA

SEQ ID NO: 13354 - RNA, 1701 nt, Artificial Sequence; identical to SEQ ID NO: 13243
  derived and/or modified CDS sequence (AUadapt) from InfluenzaA__ALA08641__HA

SEQ ID NO: 13355 - RNA, 1701 nt, Artificial Sequence; identical to SEQ ID NO: 13243
  derived and/or modified CDS sequence (AUadapt) from InfluenzaA__ALA08642__HA

SEQ ID NO: 13356 - RNA, 1701 nt, Artificial Sequence; identical to SEQ ID NO: 13243
  derived and/or modified CDS sequence (AUadapt) from InfluenzaA__ALA08643__HA

SEQ ID NO: 13357 - RNA, 1701 nt, Artificial Sequence; identical to SEQ ID NO: 68
  derived and/or modified CDS sequence (AUadapt) from InfluenzaA__ALA08644__HA

SEQ ID NO: 13358 - RNA, 1701 nt, Artificial Sequence
  derived and/or modified CDS sequence (AUadapt) from InfluenzaA__ALA08645__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgacaucugguccuacaacgccgagcugcuggucgcccucgagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcugugcgucgcccuccugggcuucaucaugugggcgugccagaaggggaacauccggugcaacaucugcaucuga

SEQ ID NO: 13359 - RNA, 1701 nt, Artificial Sequence; identical to SEQ ID NO: 68
  derived and/or modified CDS sequence (AUadapt) from InfluenzaA__ALA08646__HA

SEQ ID NO: 13360 - RNA, 1701 nt, Artificial Sequence; identical to SEQ ID NO: 68
  derived and/or modified CDS sequence (AUadapt) from InfluenzaA__ALA08647__HA

SEQ ID NO: 13361 - RNA, 1701 nt, Artificial Sequence; identical to SEQ ID NO: 13243
  derived and/or modified CDS sequence (AUadapt) from InfluenzaA__ALA08648__HA

SEQ ID NO: 13362 - RNA, 1701 nt, Artificial Sequence
  derived and/or modified CDS sequence (AUadapt) from InfluenzaA__ALA08650__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgagcgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13363 - RNA, 1701 nt, Artificial Sequence; identical to SEQ ID NO: 13243
  derived and/or modified CDS sequence (AUadapt) from InfluenzaA__ALA08652__HA

SEQ ID NO: 13364 - RNA, 1701 nt, Artificial Sequence; identical to SEQ ID NO: 68
  derived and/or modified CDS sequence (AUadapt) from InfluenzaA__ALA08653__HA

SEQ ID NO: 13365 - RNA, 1701 nt, Artificial Sequence
  derived and/or modified CDS sequence (AUadapt) from InfluenzaA__ALA08654__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaagagcugcuuccugcucugcguggcccugcugggcuucaucaugugggccugccagaaggggaacauccgcugcaacaucugcaucuga

SEQ ID NO: 13366 - RNA, 1701 nt, Artificial Sequence; identical to SEQ ID NO: 13243
  derived and/or modified CDS sequence (AUadapt) from InfluenzaA__ALA08655__HA

SEQ ID NO: 13367 - RNA, 1701 nt, Artificial Sequence; identical to SEQ ID NO: 13243
  derived and/or modified CDS sequence (AUadapt) from InfluenzaA__ALA08656__HA

SEQ ID NO: 13368 - RNA, 1701 nt, Artificial Sequence
  derived and/or modified CDS sequence (AUadapt) from InfluenzaA__ALA08657__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucaucgagcggucgaaggccuacuccaacugcuaccccuacgacgugccggacuacgcgagccugcgcucccucguggccucguccggcacccuggaguucaacgacgagagcuucaacugggccggcgucacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcgugcaccaccccgggacggacaaggaccagaucuuccucuacgcccagagcucggggcggaucaccgucuccaccaagcgcagccagcaggccgugaucccgaacaucggcucccggccccgcauccggaacauccccucgcgcaucuccaucuacuggaccaucgugaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgucaaccgcaucaccuacggggcgugcccccgguacgugaagcaguccacccugaagcuggccacgggcaugcgcaacgugcccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgaggucgagggccggauccaggaccucgagaaguacguggaggacacgaagaucgaccugugguccuacaacgccgagcugcucguggcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacgucuaccgggacgaggcccugaacaaccgcuuccagaucaaggggguggagcucaagagcggcuacaaggacuggauccuguggaucagcuucgccaucuccugcuuccugcucugcguggcccugcugggcuucaucaugugggcgugccagaaggggaacauccggugcaacaucugcaucuga

SEQ ID NO: 13369 - RNA, 1701 nt, Artificial Sequence; identical to SEQ ID NO: 13243
  derived and/or modified CDS sequence (AUadapt) from InfluenzaA__ALA08658__HA

SEQ ID NO: 13370 - RNA, 1701 nt, Artificial Sequence; identical to SEQ ID NO: 13230
  derived and/or modified CDS sequence (AUadapt) from InfluenzaA__ALA08659__HA

SEQ ID NO: 13371 - RNA, 1701 nt, Artificial Sequence
  derived and/or modified CDS sequence (AUadapt) from InfluenzaA__ALA08660__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacggcacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13372 - RNA, 1701 nt, Artificial Sequence
  derived and/or modified CDS sequence (AUadapt) from InfluenzaA__ALA08662__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccugagcgggaaguccucgaucaugcgguccgacgcccccaucggcaagugcaagagcgagugcaucacccccaacggcuccauccccaacgacaagccguuccagaacgugaaccgcaucacguacggggccugcccccgguacgugaagcacucgacccugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccuggagaaguacgucgaggacagcaagaucgaccugugguccuacaacgccgagcuccugguggcccuggagaaccagcacaccaucgaccucaccgacucggagaugaacaagcuguucgagaagacgaagaagcagcugcgcgagaacgccgaggacauggggaacggcugcuucaagaucuaccacaagugcgacaacgcgugcaucggguccauccgcaacggcaccuacgaccacaacguguaccgggacgaggcccucaacaaccgcuuccagaucaagggggucgagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 13373 - RNA, 1701 nt, Artificial Sequence; identical to SEQ ID NO: 13344
  derived and/or modified CDS sequence (AUadapt) from InfluenzaA__ALA08663__HA

SEQ ID NO: 13374 - RNA, 1701 nt, Artificial Sequence; identical to SEQ ID NO: 13372
  derived and/or modified CDS sequence (AUadapt) from InfluenzaA__ALA08665__HA

SEQ ID NO: 13375 - RNA, 1701 nt, Artificial Sequence
  derived and/or modified CDS sequence (AUadapt) from InfluenzaA__ALA08666__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcgucgagcucaagagcggcuacaaggacuggauccuguggaucuccuucgccaugagcugcuuccugcugugcguggcccugcucggguucaucaugugggcgugccagaagggcaacauccggugcaacaucugcaucuga

SEQ ID NO: 13376 - RNA, 1701 nt, Artificial Sequence
  derived and/or modified CDS sequence (AUadapt) from InfluenzaA__ALA08667__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcgguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13377 - RNA, 1701 nt, Artificial Sequence
  derived and/or modified CDS sequence (AUadapt) from InfluenzaA__ALA08668__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggccaucaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13378 - RNA, 1701 nt, Artificial Sequence; identical to SEQ ID NO: 13344
  derived and/or modified CDS sequence (AUadapt) from InfluenzaA__ALA08669__HA

SEQ ID NO: 13379 - RNA, 1701 nt, Artificial Sequence; identical to SEQ ID NO: 13237
  derived and/or modified CDS sequence (AUadapt) from InfluenzaA__ALA08670__HA

SEQ ID NO: 13380 - RNA, 1701 nt, Artificial Sequence; identical to SEQ ID NO: 13344
  derived and/or modified CDS sequence (AUadapt) from InfluenzaA__ALA08671__HA

SEQ ID NO: 13381 - RNA, 1701 nt, Artificial Sequence; identical to SEQ ID NO: 13344
  derived and/or modified CDS sequence (AUadapt) from InfluenzaA__ALA08672__HA

SEQ ID NO: 13382 - RNA, 1701 nt, Artificial Sequence; identical to SEQ ID NO: 13237
  derived and/or modified CDS sequence (AUadapt) from InfluenzaA__ALA08673__HA

SEQ ID NO: 13383 - RNA, 1701 nt, Artificial Sequence; identical to SEQ ID NO: 13344
  derived and/or modified CDS sequence (AUadapt) from InfluenzaA__ALA08674__HA

SEQ ID NO: 13384 - RNA, 1701 nt, Artificial Sequence; identical to SEQ ID NO: 68
  derived and/or modified CDS sequence (AUadapt) from InfluenzaA__ALA08675__HA

SEQ ID NO: 13385 - RNA, 1701 nt, Artificial Sequence; identical to SEQ ID NO: 13344
  derived and/or modified CDS sequence (AUadapt) from InfluenzaA__ALA08676__HA

SEQ ID NO: 13386 - RNA, 1701 nt, Artificial Sequence; identical to SEQ ID NO: 13344
  derived and/or modified CDS sequence (AUadapt) from InfluenzaA__ALA08677__HA

SEQ ID NO: 13387 - RNA, 1701 nt, Artificial Sequence; identical to SEQ ID NO: 13344
  derived and/or modified CDS sequence (AUadapt) from InfluenzaA__ALA08678__HA

SEQ ID NO: 13388 - RNA, 1701 nt, Artificial Sequence; identical to SEQ ID NO: 13344
  derived and/or modified CDS sequence (AUadapt) from InfluenzaA__ALA08679__HA

SEQ ID NO: 13389 - RNA, 1701 nt, Artificial Sequence; identical to SEQ ID NO: 13344
  derived and/or modified CDS sequence (AUadapt) from InfluenzaA__ALA08680__HA

SEQ ID NO: 13390 - RNA, 1701 nt, Artificial Sequence; identical to SEQ ID NO: 13243
  derived and/or modified CDS sequence (AUadapt) from InfluenzaA__ALA08681__HA

SEQ ID NO: 13391 - RNA, 1701 nt, Artificial Sequence; identical to SEQ ID NO: 13322
  derived and/or modified CDS sequence (AUadapt) from InfluenzaA__ALA08682__HA

SEQ ID NO: 13392 - RNA, 1701 nt, Artificial Sequence; identical to SEQ ID NO: 13243
  derived and/or modified CDS sequence (AUadapt) from InfluenzaA__ALA08683__HA

SEQ ID NO: 13393 - RNA, 1701 nt, Artificial Sequence
  derived and/or modified CDS sequence (AUadapt) from InfluenzaA__ALA08684__HA
augaagaccaucaucgcccugucgcacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugucgaccaagggcucccagcaggccgugaucccgaacaucggcagccggccccgcauccgggacauccccucccgcaucucgaucuacuggacgaucgucaagcccggggacauccugcugaucaacuccaccggcaaccucaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgccugcccccgguacgugaagcacucgacgcugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacccaggcggccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggucguacaacgccgagcugcucguggcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcaucgagcucaaguccggcuacaaggacuggauccuguggaucucguucgccaucagcugcuuccugcucugcgucgcccugcugggguucaucaugugggccugccagaagggcaacauccggugcaacaucugcaucuga

SEQ ID NO: 13394 - RNA, 1701 nt, Artificial Sequence; identical to SEQ ID NO: 68
  derived and/or modified CDS sequence (AUadapt) from InfluenzaA__ALA08686__HA

SEQ ID NO: 13395 - RNA, 1701 nt, Artificial Sequence
  derived and/or modified CDS sequence (AUadapt) from InfluenzaA__ALA08687__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcugaucgccuccagcggcacccucgaguucaacaacgaguccuucaacuggacgggggucacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccucggggcgcaucaccgucagcacgaagcggucccagcaggccgugaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13396 - RNA, 1701 nt, Artificial Sequence; identical to SEQ ID NO: 13337
  derived and/or modified CDS sequence (AUadapt) from InfluenzaA__ALA08688__HA

SEQ ID NO: 13397 - RNA, 1701 nt, Artificial Sequence; identical to SEQ ID NO: 68
  derived and/or modified CDS sequence (AUadapt) from InfluenzaA__ALE31612__HA

SEQ ID NO: 13398 - RNA, 1701 nt, Artificial Sequence
  derived and/or modified CDS sequence (AUadapt) from InfluenzaA__ALE31613__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagggcucccagcaggccgugaucccgaacaucggcucgcggccccgcauccgggacauccccucccgcaucagcaucuacuggaccaucgucaagcccggggacauccugcugaucuccucgaccggcaaccucaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucacguacggcgccugcccccgguacgugaagcacuccacccugaagcuggcgaccgggaugcgcaacguccccgagaagcagacccggggcaucuucggggccaucgccggcuucaucgagaacggcugggaggggaugguggacggcugguacggguuccgccaccagaacucggagggccgggggcaggccgccgaccucaaguccacgcaggcggccaucgaccagaucaacggcaagcugaaccgccugaucggcaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacaugggcaacgggugcuucaagaucuaccacaagugcgacaacgcgugcaucggcuccauccgcaacgggaccuacgaccacaacguguaccgggacgaggcccugaacaaccgcuuccagaucaagggcgucgagcucaagagcggcuacaaggacuggauccuguggaucagcuucgccaucuccugccugcuccugugcguggcccugcucggguucaucaugugggccugccagaagggcaacauccggugcaacaucugcaucuga

SEQ ID NO: 13399 - RNA, 1701 nt, Artificial Sequence
  derived and/or modified CDS sequence (AUadapt) from InfluenzaA__ALE31614__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucgggaagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13400 - RNA, 1701 nt, Artificial Sequence
  derived and/or modified CDS sequence (AUadapt) from InfluenzaA__ALE31615__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccaccugaacuucaaguaccccgcgcugaacgugaccaugcccaacaacgagcaguucgacaagcucuacaucuggggcguccaccaccccgggacggacaaggaccagaucuuccuguacgcccagagcuccggccggaucaccgugagcaccaagcgcucgcagcaggccgugaucccgaacaucggcucccggccccgcauccggaacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgcgugcccccgguacgugaagcaguccacccugaagcucgccacggggaugcgcaacguccccgagaagcagacccggggcaucuucggggccaucgccggcuucaucgagaacggcugggaggggaugguggacggcugguacggguuccgccaccagaacucggagggccgggggcaggccgcggaccugaaguccacccaggccgccaucgaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgcggaggacaugggcaacgggugcuucaagaucuaccacaagugcgacaacgccugcaucgaguccauccgcaacggcacguacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 13401 - RNA, 1701 nt, Artificial Sequence; identical to SEQ ID NO: 68
  derived and/or modified CDS sequence (AUadapt) from InfluenzaA__ALE31616__HA

SEQ ID NO: 13402 - RNA, 1701 nt, Artificial Sequence; identical to SEQ ID NO: 68
  derived and/or modified CDS sequence (AUadapt) from InfluenzaA__ALE31617__HA

SEQ ID NO: 13403 - RNA, 1701 nt, Artificial Sequence; identical to SEQ ID NO: 68
  derived and/or modified CDS sequence (AUadapt) from InfluenzaA__ALE31618__HA

SEQ ID NO: 13404 - RNA, 1701 nt, Artificial Sequence; identical to SEQ ID NO: 13344
  derived and/or modified CDS sequence (AUadapt) from InfluenzaA__ALE31619__HA

SEQ ID NO: 13405 - RNA, 1701 nt, Artificial Sequence; identical to SEQ ID NO: 68
  derived and/or modified CDS sequence (AUadapt) from InfluenzaA__ALE31620__HA

SEQ ID NO: 13406 - RNA, 1701 nt, Artificial Sequence
  derived and/or modified CDS sequence (AUadapt) from InfluenzaA__ALE31622__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgugcccaucggcaagugcaagucggagugcaucacccccaacggcuccauccccaacgacaagccguuccagaacgugaaccggaucacguacggggccugcccccgcuacgucaagcacagcacccugaagcuggccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagucgacgcaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacgucuaccgcgacgaggcgcugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13407 - RNA, 1701 nt, Artificial Sequence; identical to SEQ ID NO: 68
  derived and/or modified CDS sequence (AUadapt) from InfluenzaA__ALE31623__HA

SEQ ID NO: 13408 - RNA, 1701 nt, Artificial Sequence; identical to SEQ ID NO: 68
  derived and/or modified CDS sequence (AUadapt) from InfluenzaA__ALE31625__HA

SEQ ID NO: 13409 - RNA, 1701 nt, Artificial Sequence; identical to SEQ ID NO: 68
  derived and/or modified CDS sequence (AUadapt) from InfluenzaA__ALE31626__HA

SEQ ID NO: 13410 - RNA, 1701 nt, Artificial Sequence; identical to SEQ ID NO: 68
  derived and/or modified CDS sequence (AUadapt) from InfluenzaA__ALE31627__HA

SEQ ID NO: 13411 - RNA, 1701 nt, Artificial Sequence; identical to SEQ ID NO: 68
  derived and/or modified CDS sequence (AUadapt) from InfluenzaA__ALE31628__HA

SEQ ID NO: 13412 - RNA, 1701 nt, Artificial Sequence; identical to SEQ ID NO: 68
  derived and/or modified CDS sequence (AUadapt) from InfluenzaA__ALE31629__HA

SEQ ID NO: 13413 - RNA, 1701 nt, Artificial Sequence; identical to SEQ ID NO: 68
  derived and/or modified CDS sequence (AUadapt) from InfluenzaA__ALE31632__HA

SEQ ID NO: 13414 - RNA, 1701 nt, Artificial Sequence
  derived and/or modified CDS sequence (AUadapt) from InfluenzaA__ALE31634__HA
augaagaccaucaucgcccugucguacauccucugccuggugcuggcccagaagauccccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacuggacgggggugacccagaacggcaccagcuccgccugcauccggcgcucguccagcuccuucuucucgcggcugaacuggcucacccaccugaacuacacguaccccgcccugaacgugaccaugcccaacaacgagcaguucgacaagcucuacaucuggggcguccaccaccccgggaccgacaaggaccagaucuuccuguacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcucaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggucguacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacaacguguaccgcgacgaggcccucaacaaccgguuccagaucaagggggucgagcugaaguccggcuacaaggacuggauccuguggaucucguucgccaucagcugcuuccuccugugcguggcccugcucggcuucaucaugugggccugccagaaggggaacauccgcugcaacaucugcaucuga

SEQ ID NO: 13415 - RNA, 1701 nt, Artificial Sequence; identical to SEQ ID NO: 68
  derived and/or modified CDS sequence (AUadapt) from InfluenzaA__ALE31635__HA

SEQ ID NO: 13416 - RNA, 1701 nt, Artificial Sequence; identical to SEQ ID NO: 68
  derived and/or modified CDS sequence (AUadapt) from InfluenzaA__ALE31636__HA

SEQ ID NO: 13417 - RNA, 1701 nt, Artificial Sequence
  derived and/or modified CDS sequence (AUadapt) from InfluenzaA__ALE31638__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgggaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagucgacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 13418 - RNA, 1701 nt, Artificial Sequence; identical to SEQ ID NO: 68
  derived and/or modified CDS sequence (AUadapt) from InfluenzaA__ALE31639__HA

SEQ ID NO: 13419 - RNA, 1701 nt, Artificial Sequence; identical to SEQ ID NO: 13237
  derived and/or modified CDS sequence (AUadapt) from InfluenzaA__ALE31640__HA

SEQ ID NO: 13420 - RNA, 1701 nt, Artificial Sequence; identical to SEQ ID NO: 13243
  derived and/or modified CDS sequence (AUadapt) from InfluenzaA__ALE31641__HA

SEQ ID NO: 13421 - RNA, 1701 nt, Artificial Sequence; identical to SEQ ID NO: 13243
  derived and/or modified CDS sequence (AUadapt) from InfluenzaA__ALE31642__HA

SEQ ID NO: 13422 - RNA, 1701 nt, Artificial Sequence
  derived and/or modified CDS sequence (AUadapt) from InfluenzaA__ALE31643__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaccgccuacuccaacugcuaccccuacgacgugccggacuacgcgagccugcgcucccucgucgccucguccggcacgcuggaguucaacgacgagagcuucaacugggccggcgugacccagaacgggaccuccucggccugcauccggggcuccaacagcuccuucuucucgcgccugaacuggcucacccacuccaacuucaaguaccccgcgcugaacgugacgaugcccaacaacgagcaguucgacaagcuguacaucuggggcguccaccaccccgggaccgacaaggaccagaucuuccucuacgcccagagcucggggcggaucaccguguccaccaagcgcagccagcaggccgugaucccgaacaucggcucccggccccgcauccggaacauccccucgcgcaucuccaucuacuggacgaucgucaagcccggcgacauccugcugaucaacagcaccgggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacgcugaagcuggccaccggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagacgaacgagaaguuccaccagaucgagaaggaguucagcgagguggagggccggauccaggaccucgagaaguacguggaggacaccaagaucgaccugugguccuacaacgccgagcugcucgucgcccuggagaaccagcacaccaucgaccugaccgacucggagaugaacaagcuguucgagaagacgaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13423 - RNA, 1701 nt, Artificial Sequence; identical to SEQ ID NO: 68
  derived and/or modified CDS sequence (AUadapt) from InfluenzaA__ALE31644__HA

SEQ ID NO: 13424 - RNA, 1701 nt, Artificial Sequence; identical to SEQ ID NO: 68
  derived and/or modified CDS sequence (AUadapt) from InfluenzaA__ALE31645__HA

SEQ ID NO: 13425 - RNA, 1701 nt, Artificial Sequence; identical to SEQ ID NO: 68
  derived and/or modified CDS sequence (AUadapt) from InfluenzaA__ALE31646__HA

SEQ ID NO: 13426 - RNA, 1701 nt, Artificial Sequence; identical to SEQ ID NO: 13243
  derived and/or modified CDS sequence (AUadapt) from InfluenzaA__ALE31647__HA

SEQ ID NO: 13427 - RNA, 1701 nt, Artificial Sequence
  derived and/or modified CDS sequence (AUadapt) from InfluenzaA__ALE31648__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagccguccgggcgcaucaccgugagcacgaagcggucgcagcaggccgugauccccaacaucggcucccgcccccggauccgcgacauccccucgcggaucuccaucuacuggaccaucgucaagccgggcgacauccugcugaucaacagcaccgggaaccucaucgcgccccgcggcuacuucaagauccgguccggcaagucguccaucaugcgcagcgacgcccccaucgggaagugcaaguccgagugcaucacccccaacggcucgaucccgaacgacaagcccuuccagaacgugaaccggaucacguacggggccugcccccgcuacgugaagcacuccacccugaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaccgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13428 - RNA, 1701 nt, Artificial Sequence; identical to SEQ ID NO: 68
  derived and/or modified CDS sequence (AUadapt) from InfluenzaA__ALE31649__HA

SEQ ID NO: 13429 - RNA, 1701 nt, Artificial Sequence; identical to SEQ ID NO: 13243
  derived and/or modified CDS sequence (AUadapt) from InfluenzaA__ALE31650__HA

SEQ ID NO: 13430 - RNA, 1701 nt, Artificial Sequence
  derived and/or modified CDS sequence (AUadapt) from InfluenzaA__ALE31652__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacaaguaccccgcccugaacgugacgaugcccaacaacgagcaguucgacaagcuguacaucuggggcguccaccaccccgggaccgacaaggaccagaucucccucuacgcgcagagcucggggcgcaucaccguguccaccaagcggagccagcaggccgugaucccgaacaucggcucccgcccccggauccgcgacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcacuccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13431 - RNA, 1701 nt, Artificial Sequence; identical to SEQ ID NO: 13337
  derived and/or modified CDS sequence (AUadapt) from InfluenzaA__ALE31653__HA

SEQ ID NO: 13432 - RNA, 1701 nt, Artificial Sequence; identical to SEQ ID NO: 68
  derived and/or modified CDS sequence (AUadapt) from InfluenzaA__ALE31654__HA

SEQ ID NO: 13433 - RNA, 1701 nt, Artificial Sequence; identical to SEQ ID NO: 68
  derived and/or modified CDS sequence (AUadapt) from InfluenzaA__ALE31655__HA

SEQ ID NO: 13434 - RNA, 1701 nt, Artificial Sequence
  derived and/or modified CDS sequence (AUadapt) from InfluenzaA__ALE31656__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggacaucuucguggagcgguccaaggccuacagcaacugcuaccccuacgacgugccggacuacgcgucccuccgcucgcuggucgccuccagcggcacccuggaguucaacaacgaguccuucaacuggacgggggugacccagaacggcaccucguccgccugcauccggcgcagcuccucguccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccuccugaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcugaaguccggcuacaaggacuggauccucuggaucagcuucgccaucagcugcuuccugcugugcgucgcccuccugggcuucaucaugugggccugccagaaggggaacauccgcugcaacaucugcaucuga

SEQ ID NO: 13435 - RNA, 1701 nt, Artificial Sequence
  derived and/or modified CDS sequence (AUadapt) from InfluenzaA__ALE31657__HA
augaagaccaucaucgcccugucguacauccucugccugguguccgcccagaagauccccggcaacgacaacucgaccgcgacgcugugccucgggcaccacgccgucccgaacggcaccaucgugaagaccaucaccaacgaccgcaucgaggugacgaacgccaccgagcugguccagaacuccagcaucggggagaucugcgacucgccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagucgagcgggcgcaucaccguguccacgaagcggucgcagcaggccgugaucccgaacaucggcucccgcccccggauccgcgacauccccagccggaucuccaucuacuggaccaucgucaagcccggcgacauccugcugaucaacucgaccgggaaccucaucgccccgcgcggcuacuucaagauccgguccgggaaguccuccaucaugcgcagcgacgcccccaucggcaagugcaaguccgagugcaucacccccaacggcucgauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13436 - RNA, 1701 nt, Artificial Sequence; identical to SEQ ID NO: 68
  derived and/or modified CDS sequence (AUadapt) from InfluenzaA__ALE31658__HA

SEQ ID NO: 13437 - RNA, 1701 nt, Artificial Sequence; identical to SEQ ID NO: 13301
  derived and/or modified CDS sequence (AUadapt) from InfluenzaA__ALE31659__HA

SEQ ID NO: 13438 - RNA, 1701 nt, Artificial Sequence; identical to SEQ ID NO: 13230
  derived and/or modified CDS sequence (AUadapt) from InfluenzaA__ALE31660__HA

SEQ ID NO: 13439 - RNA, 1701 nt, Artificial Sequence
  derived and/or modified CDS sequence (AUadapt) from InfluenzaA__ALE31661__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagaagucccagcaggccgugaucccgaacaucggcucgcggccccgcauccgggacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13440 - RNA, 1701 nt, Artificial Sequence
  derived and/or modified CDS sequence (AUadapt) from InfluenzaA__ALE31662__HA
augaagaccaucaucgcccugucguacauccucugccugguguucgcccagaagauccccggcaacgacaacuccaccgcgacgcugugccucgggcaccacgccgucccgaacggcaccaucgugaagaccaucgccaacgaccgcaucgaggugaccaacgccacggagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggcguacucgaacugcuaccccuacgacgugccggacuacgccucccugcgcagccuggucgccuccucgggcacccucgaguucaacaacgaguccuucaacuggaccggggugacgcagaacggcaccagcuccgccugcauccggcgcucguccagcuccuucuucucgcggcugaacuggcugacccaccucaacuacaccuaccccgcgcugaacgugacgaugcccaacaacgagcaguucgacaagcuguacaucuggggcguccaccaccccgggaccgacaaggaccagaucuuccucuacgcccaguccagcgggcgcaucaccgugucgaccaagggcucccagcaggccgugaucccgaacaucggcagccggccccgcauccgggacauccccucccgcaucucgaucuacuggacgaucgucaagcccggggacauccugcugaucaacuccaccggcaaccucaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcacucgacgcugaagcuggccaccgggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagagcacccaggccgccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggucguacaacgccgagcugcucguggcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcagcauccgcaacgggaccuacgaccacaacguguaccgggacgaggcccugaacaaccgcuuccagaucaagggcgucgagcucaaguccggcuacaaggacuggauccuguggaucucguucgccaucagcugccugcuccugugcguggcccugcucggguucaucaugugggcgugccagaagggcaacauccggugcaacaucugcaucuga

SEQ ID NO: 13441 - RNA, 1701 nt, Artificial Sequence; identical to SEQ ID NO: 164
  derived and/or modified CDS sequence (AUadapt) from InfluenzaA__ALE31663__HA

SEQ ID NO: 13442 - RNA, 1701 nt, Artificial Sequence
  derived and/or modified CDS sequence (AUadapt) from InfluenzaA__ALE31666__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13443 - RNA, 1701 nt, Artificial Sequence
  derived and/or modified CDS sequence (AUadapt) from InfluenzaA__ALE31667__HA
augaagaccaucaucgcccugucguacauccucugccugguguucgcccagaagauccccggcaacgacaacuccaccgcgacgcugugccucgggcaccacgccguccugaacggcaccaucgugaagaccaucaccaacgaccgcaucgaggugacgaacgccaccgagcugguccagaacagcuccaucggggagaucugcgacucgccgcaccagauccucgacggcgagaacugcacccugaucgacgcccugcucggggacccccagugcgacggcuuccagaacaagaagugggaccuguucguggagcgguccaaggccuacagcaacugcuaccccuacgacgugcccgacuacgcgucccugcgcucgcucgucgccuccagcggcacccuggaguucaacaacgaguccuucaacuggacgggggugacccagaacggcaccucguccgccugcauccgcaagagcuccagcuccuucuucucgcggcugaacuggcucacccaccugaacuacacguacccggcccugaacgugaccaugcccaacaacgagcaguucgacaagcucuacaucuggggcguccaccaccccgggaccgacaaggaccagaucuuccuguacgcgcgguccagcgggcgcaucaccgugucgacgaagcggucccagcaggccgugauccccaacaucggcagccgcccgcggauccgcgacauccccucccggaucucgaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaagucggagugcaucacccccaacggcuccauccccaacgacaagcccuuccagaacgugaaccggaucacguacggggccugcccgcgcuacgugaagcacagcacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13444 - RNA, 1701 nt, Artificial Sequence; identical to SEQ ID NO: 68
  derived and/or modified CDS sequence (AUadapt) from InfluenzaA__ALE31668__HA

SEQ ID NO: 13445 - RNA, 1701 nt, Artificial Sequence; identical to SEQ ID NO: 68
  derived and/or modified CDS sequence (AUadapt) from InfluenzaA__ALE31669__HA

SEQ ID NO: 13446 - RNA, 1701 nt, Artificial Sequence
  derived and/or modified CDS sequence (AUadapt) from InfluenzaA__ALE31670__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagaugcgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccucuggaucagcuucgccaucuccugcuuccugcugugcgucgcccuccugggcuucaucaugugggcgugccagaaggggaacauccggugcaacaucugcaucuga

SEQ ID NO: 13447 - RNA, 1701 nt, Artificial Sequence; identical to SEQ ID NO: 68
  derived and/or modified CDS sequence (AUadapt) from InfluenzaA__ALE31671__HA

SEQ ID NO: 13448 - RNA, 1701 nt, Artificial Sequence; identical to SEQ ID NO: 68
  derived and/or modified CDS sequence (AUadapt) from InfluenzaA__ALE31672__HA

SEQ ID NO: 13449 - RNA, 1701 nt, Artificial Sequence; identical to SEQ ID NO: 13243
  derived and/or modified CDS sequence (AUadapt) from InfluenzaA__ALE31673__HA

SEQ ID NO: 13450 - RNA, 1701 nt, Artificial Sequence
  derived and/or modified CDS sequence (AUadapt) from InfluenzaA__ALE31674__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcacuccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13451 - RNA, 1701 nt, Artificial Sequence
  derived and/or modified CDS sequence (AUadapt) from InfluenzaA__ALE31675__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcaacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagggcucccagcaggccgugaucccgaacaucggcucgcggccccgcauccgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13452 - RNA, 1701 nt, Artificial Sequence
  derived and/or modified CDS sequence (AUadapt) from InfluenzaA__ALE31676__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgccccaagauccgggacauccccucccgcaucagcaucuacuggaccaucgucaagcccggcgacauccugcugaucaacuccaccgggaaccucaucgccccgcggggcuacuucaagauccugagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacagcaagaucgaccugugguccuacaacgccgagcuccugguggcccuggagaaccagcacaccaucgaccucaccgacucggagaugaacaagcuguucgagaagacgaagaagcagcugcgggagaacgccgaggacauggggaacggcugcuucaagaucuaccacaagugcgacaacgcgugcaucggguccauccgcaacggcaccuacgaccacaacguguaccgcgacgaggcccucaacaaccgguuccagaucaagggggucgagcucaagagcggcuacaaggacuggauccuguggaucagcuucgccaucuccugcuuccugcugugcguggcccugcucggcuucaucaugugggccugccagaaggggaacauccgcugcaacaucugcaucuga

SEQ ID NO: 13453 - RNA, 1701 nt, Artificial Sequence; identical to SEQ ID NO: 13344
  derived and/or modified CDS sequence (AUadapt) from InfluenzaA__ALE31677__HA

SEQ ID NO: 13454 - RNA, 1701 nt, Artificial Sequence; identical to SEQ ID NO: 68
  derived and/or modified CDS sequence (AUadapt) from InfluenzaA__ALE31678__HA

SEQ ID NO: 13455 - RNA, 1701 nt, Artificial Sequence; identical to SEQ ID NO: 68
  derived and/or modified CDS sequence (AUadapt) from InfluenzaA__ALE31679__HA

SEQ ID NO: 13456 - RNA, 1701 nt, Artificial Sequence; identical to SEQ ID NO: 13302
  derived and/or modified CDS sequence (AUadapt) from InfluenzaA__ALE31680__HA

SEQ ID NO: 13457 - RNA, 1701 nt, Artificial Sequence; identical to SEQ ID NO: 13301
  derived and/or modified CDS sequence (AUadapt) from InfluenzaA__ALE31681__HA

SEQ ID NO: 13458 - RNA, 1701 nt, Artificial Sequence; identical to SEQ ID NO: 68
  derived and/or modified CDS sequence (AUadapt) from InfluenzaA__ALE31682__HA

SEQ ID NO: 13459 - RNA, 1701 nt, Artificial Sequence; identical to SEQ ID NO: 68
  derived and/or modified CDS sequence (AUadapt) from InfluenzaA__ALE31683__HA

SEQ ID NO: 13460 - RNA, 1701 nt, Artificial Sequence; identical to SEQ ID NO: 68
  derived and/or modified CDS sequence (AUadapt) from InfluenzaA__ALE31684__HA

SEQ ID NO: 13461 - RNA, 1701 nt, Artificial Sequence; identical to SEQ ID NO: 68
  derived and/or modified CDS sequence (AUadapt) from InfluenzaA__ALE31685__HA

SEQ ID NO: 13462 - RNA, 1701 nt, Artificial Sequence; identical to SEQ ID NO: 68
  derived and/or modified CDS sequence (AUadapt) from InfluenzaA__ALE31686__HA

SEQ ID NO: 13463 - RNA, 1701 nt, Artificial Sequence
  derived and/or modified CDS sequence (AUadapt) from InfluenzaA__ALE31687__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgagucgauccggaacgggaccuacgaccacaacguguaccgcgacgaggcccugaacaaccgguuccagaucaagggcgucgagcucaaguccggguacaaggacuggauccuguggaucagcuucgccaucagcugcuuccugcucugcguggcccugcugggcuucaucaugugggccugccagaagggcaacauccgcugcaacaucugcaucuga

SEQ ID NO: 13464 - RNA, 1701 nt, Artificial Sequence
  derived and/or modified CDS sequence (AUadapt) from InfluenzaA__ALE31688__HA
augaagaccaccaucgcccugucguacauccucugccugguguucgcccagaagcugcccgagaacgacaacuccacggcgacccucugccugggccaccacgccgucccgaacgggaccaucgugaagaccaucacgucggaccgcaucgaggugaccaacgccaccgagcugguccagaacuccagcaucggcgagaucugcgacucgccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgucgcugcgcucccucgucgccagcuccggcacgcuggaguucaacgacgagucguucaacugggccggcgugacccagaacgggaccuccagcgccugcauccggggcuccaacucguccuucuucagccgccugaacuggcucacccacuccaacuucaaguaccccgcgcugaacgugacgaugcccaacaacgagcaguucgacaagcuguacaucuggggcguccaccaccccgggaccgacaaggaccagaucuuccucuacgcccagucgagcgggcggaucaccguguccaccaagcgcucgcagcaggccgugaucccgaacaucggcucccggccccgcauccggaacauccccagccgcaucuccaucuacuggacgaucgucaagcccggcgacauccugcugaucaacucgaccgggaaccucaucgccccgcggggcuacuucaagauccgcuccgggaaguccuccaucaugcggagcgacgcccccaucggcaagugcaaguccgagugcaucacccccaacggcucgauccccaacgacaagccguuccagaacgugaaccgcaucaccuacggggcgugcccccgguacgugaagcaguccacgcugaagcuggccaccggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagacgaacgagaaguuccaccagaucgagaaggaguucucggagguggagggccggauccaggaccucgagaaguacguggaggacaccaagaucgaccugugguccuacaacgccgagcugcucgucgcccuggagaaccagcacaccaucgaccugaccgacagcgagaugaacaagcuguucgagaagacgaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaaggggguggagcucaagucgggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13465 - RNA, 1701 nt, Artificial Sequence; identical to SEQ ID NO: 68
  derived and/or modified CDS sequence (AUadapt) from InfluenzaA__ALE31689__HA

SEQ ID NO: 13466 - RNA, 1701 nt, Artificial Sequence
  derived and/or modified CDS sequence (AUadapt) from InfluenzaA__ALE31690__HA
augaagaccaucaucgcccugucgugcauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccagcugcauccggggguccaacucguccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagucgagcggccggaucaccguguccaccaagcgcucgcagcaggccgugaucccgaacaucggcucccggccccgcauccgggacauccccagccgcaucuccaucuacuggaccaucgucaagcccggggacauccugcucaucaacucgacgggcaaccugaucgccccgcggggguacuucaagauccgcuccggcaagagcuccaucaugcggucggacgcccccaucggcaagugcaaguccgagugcaucacccccaacgggagcauccccaacgacaagccguuccagaacgugaaccgcaucaccuacggcgccugcccccgguacgugaagcaguccacccugaagcucgcgacggggaugcgcaacguccccgagcggcagacccgcggcaucuucggggccaucgccggcuucaucgagaacggcugggaggggaugguggacggcugguacggguuccggcaccagaacucggagggccgcgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacucggagaugaacaagcuguucgagaagaccaagaagcagcugcgcgagaacgccgaggacaugggcaacgggugcuucaagaucuaccacaagugcgacaacgcgugcaucggcuccauccggaacgggacguacgaccacaacguguaccgcgacgaggcccucaacaaccgguuccagaucaagggcgucgagcucaagagcggcuacaaggacuggauccuguggaucagcuucgccaucuccugcuuccugcugugcguggcccugcucggguucaucaugugggccugccagaagggcaacauccgcugcaacaucugcaucuga

SEQ ID NO: 13467 - RNA, 1701 nt, Artificial Sequence; identical to SEQ ID NO: 162
  derived and/or modified CDS sequence (AUadapt) from InfluenzaA__ALE31691__HA

SEQ ID NO: 13468 - RNA, 1701 nt, Artificial Sequence
  derived and/or modified CDS sequence (AUadapt) from InfluenzaA__ALE31692__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcuaccgcccccggauccgcgacauccccagccggaucuccaucuacuggaccaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13469 - RNA, 1701 nt, Artificial Sequence; identical to SEQ ID NO: 13468
  derived and/or modified CDS sequence (AUadapt) from InfluenzaA__ALE31693__HA

SEQ ID NO: 13470 - RNA, 1701 nt, Artificial Sequence; identical to SEQ ID NO: 68
  derived and/or modified CDS sequence (AUadapt) from InfluenzaA__ALE31694__HA

SEQ ID NO: 13471 - RNA, 1701 nt, Artificial Sequence; identical to SEQ ID NO: 13468
  derived and/or modified CDS sequence (AUadapt) from InfluenzaA__ALE31695__HA

SEQ ID NO: 13472 - RNA, 1701 nt, Artificial Sequence; identical to SEQ ID NO: 13344
  derived and/or modified CDS sequence (AUadapt) from InfluenzaA__ALE31696__HA

SEQ ID NO: 13473 - RNA, 1701 nt, Artificial Sequence; identical to SEQ ID NO: 13468
  derived and/or modified CDS sequence (AUadapt) from InfluenzaA__ALE31697__HA

SEQ ID NO: 13474 - RNA, 1701 nt, Artificial Sequence
  derived and/or modified CDS sequence (AUadapt) from InfluenzaA__ALE31698__HA
augaagaccaucaucgcccugucguacauccucugcaugguguucgcccagaagauccccggcaacgacaacuccaccgcgacgcugugccuggggcaccacgccgucccgaacggcaccaucgugaagaccaucaccaacgaccgcaucgaggugacgaacgccaccgagcucguccagaacagcuccaucggggagaucugcgacucgccccaccagauccuggacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcucgcuggucgccuccagcggcacccuggaguucaacaacgaguccuucaacuggacgggggugacccagaacggcaccucguccgccugcauccggcgcagcuccucguccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccuccugaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13475 - RNA, 1701 nt, Artificial Sequence
  derived and/or modified CDS sequence (AUadapt) from InfluenzaA__ALE31699__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccgaacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagucgacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggcgugccagaaggggaacauccgcugcaacaucugcaucuga

SEQ ID NO: 13476 - RNA, 1701 nt, Artificial Sequence; identical to SEQ ID NO: 68
  derived and/or modified CDS sequence (AUadapt) from InfluenzaA__ALE31700__HA

SEQ ID NO: 13477 - RNA, 1701 nt, Artificial Sequence; identical to SEQ ID NO: 68
  derived and/or modified CDS sequence (AUadapt) from InfluenzaA__ALE31701__HA

SEQ ID NO: 13478 - RNA, 1701 nt, Artificial Sequence; identical to SEQ ID NO: 13243
  derived and/or modified CDS sequence (AUadapt) from InfluenzaA__ALE31702__HA

SEQ ID NO: 13479 - RNA, 1701 nt, Artificial Sequence; identical to SEQ ID NO: 68
  derived and/or modified CDS sequence (AUadapt) from InfluenzaA__ALE31703__HA

SEQ ID NO: 13480 - RNA, 1701 nt, Artificial Sequence; identical to SEQ ID NO: 68
  derived and/or modified CDS sequence (AUadapt) from InfluenzaA__ALE31704__HA

SEQ ID NO: 13481 - RNA, 1701 nt, Artificial Sequence; identical to SEQ ID NO: 13243
  derived and/or modified CDS sequence (AUadapt) from InfluenzaA__ALE31705__HA

SEQ ID NO: 13482 - RNA, 1701 nt, Artificial Sequence
  derived and/or modified CDS sequence (AUadapt) from InfluenzaA__ALE31706__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagggcucccagcaggccgugaucccgaacaucggcagccggccccgcauccgggacauccccucccgcaucucgaucuacuggaccaucgucaagcccggggacauccugcugaucaacuccaccggcaaccucaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucacguacggcgccugcccccgguacgugaagcacucgacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucucguucgccaucagcugccugcuccugugcguggcccugcucggguucaucaugugggccugccagaagggcaacauccggugcaacaucugcaucuga

SEQ ID NO: 13483 - RNA, 1701 nt, Artificial Sequence; identical to SEQ ID NO: 13372
  derived and/or modified CDS sequence (AUadapt) from InfluenzaA__ALE31707__HA

SEQ ID NO: 13484 - RNA, 1701 nt, Artificial Sequence; identical to SEQ ID NO: 13372
  derived and/or modified CDS sequence (AUadapt) from InfluenzaA__ALE31708__HA

SEQ ID NO: 13485 - RNA, 1701 nt, Artificial Sequence; identical to SEQ ID NO: 164
  derived and/or modified CDS sequence (AUadapt) from InfluenzaA__ALE31709__HA

SEQ ID NO: 13486 - RNA, 1701 nt, Artificial Sequence
  derived and/or modified CDS sequence (AUadapt) from InfluenzaA__ALE31710__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgccugcggauccgcgacauccccucccggaucagcaucuacuggaccaucgucaagcccggcgacauccugcucaucaacuccaccgggaaccugaucgcgccccgcggcuacuucaagauccugucggggaaguccagcaucaugcgguccgacgccccgaucggcaagugcaagagcgagugcaucacccccaacggcuccauccccaacgacaagcccuuccagaacgugaaccgcaucacguacggggccugcccgcgguacgugaagcacucgacccucaagcuggccaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgagguggagggccggauccaggaccuggagaaguacgucgaggacagcaagaucgaccucugguccuacaacgccgagcugcugguggcccucgagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccgcaacggcaccuacgaccacaacguguaccgggacgaggcccugaacaaccgcuuccagaucaagggggucgagcucaagagcggcuacaaggacuggauccuguggaucagcuucgccaucuccugcuuccugcugugcguggcccuccugggcuucaucaugugggccugccagaaggggaacauccggugcaacaucugcaucuga

SEQ ID NO: 13487 - RNA, 1701 nt, Artificial Sequence; identical to SEQ ID NO: 13372
  derived and/or modified CDS sequence (AUadapt) from InfluenzaA__ALE31711__HA

SEQ ID NO: 13488 - RNA, 1701 nt, Artificial Sequence; identical to SEQ ID NO: 13230
  derived and/or modified CDS sequence (AUadapt) from InfluenzaA__ALE31712__HA

SEQ ID NO: 13489 - RNA, 1701 nt, Artificial Sequence
  derived and/or modified CDS sequence (AUadapt) from InfluenzaA__ALE31713__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccgcaagucguccagcuccuucuucucgcggcugaacuggcugacccaccucaacuacacguaccccgcccugaacgugaccaugcccaacaacgagcaguucgacaagcuguacaucugggggauccaccaccccggcaccgacaaggaccagaucuuccucuacgcgcgguccagcgggcgcaucaccgucucgacgaagcggucccagcaggccgugaucccgaacaucggcagccgcccccggauccgcgacauccccucccggaucucgaucuacuggaccaucgugaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgucaaccggaucacguacggggccugcccccgcuacgugaagcacucgacccugaagcuggcgaccggcaugcggaacauccccgagaagcagaccaaggggaucuucggcgccaucgccggguucaucgagaacggcugggagggcaugguggacgggugguacggcuuccgccaccagaacuccgaggggcggggccaggccgccgaccucaagagcacgcaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacgucuaccgggacgaggcccugaacaaccgcuuccagaucaaggggguggagcucaaguccggcuacaaggacuggauccuguggaucucguucgccaccagcugcuuccugcucugcguggcccugcugggcuucaucaugugggccugccagaaggggaacauccggugcaacaucugcaucuga

SEQ ID NO: 13490 - RNA, 1701 nt, Artificial Sequence; identical to SEQ ID NO: 13344
  derived and/or modified CDS sequence (AUadapt) from InfluenzaA__ALE31714__HA

SEQ ID NO: 13491 - RNA, 1701 nt, Artificial Sequence; identical to SEQ ID NO: 13344
  derived and/or modified CDS sequence (AUadapt) from InfluenzaA__ALE31715__HA

SEQ ID NO: 13492 - RNA, 1701 nt, Artificial Sequence; identical to SEQ ID NO: 13372
  derived and/or modified CDS sequence (AUadapt) from InfluenzaA__ALE31716__HA

SEQ ID NO: 13493 - RNA, 1701 nt, Artificial Sequence
  derived and/or modified CDS sequence (AUadapt) from InfluenzaA__ALE31717__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccgcaagucguccagcuccuucuucucgcggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcgguccagcgggcgcaucaccgugucgaccaagacgucccagcaggccgugaucccgaacaucggcagccggccccgcauccgggacauccccucccgcaucucgaucuacuggaccaucgucaagcccggcgacauccugcugaucaacuccaccgggaaccucaucgccccgcggggcuacuucaagauccgcagcgggaaguccucgaucaugcgguccgacgcccccaucggcaagugcaagagcgagugcaucacccccaacggcuccauccccaacgacaagccguuccagaacgugaaccgcacgaccuacggggccugcccccgguacgugaagcacucgacccugaagcuggcgaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcucaaguccggcuacaaggacuggauccuguggaucucguucgccaucagcugcuuccugcucugcguggcccugcugggcuucaucaugugggccugccagaaggggaacauccggugcaacaucugcaucuga

SEQ ID NO: 13494 - RNA, 1701 nt, Artificial Sequence; identical to SEQ ID NO: 13344
  derived and/or modified CDS sequence (AUadapt) from InfluenzaA__ALE31718__HA

SEQ ID NO: 13495 - RNA, 1701 nt, Artificial Sequence
  derived and/or modified CDS sequence (AUadapt) from InfluenzaA__ALE31719__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacauccccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13496 - RNA, 1701 nt, Artificial Sequence; identical to SEQ ID NO: 13230
  derived and/or modified CDS sequence (AUadapt) from InfluenzaA__ALE31720__HA

SEQ ID NO: 13497 - RNA, 1701 nt, Artificial Sequence; identical to SEQ ID NO: 13243
  derived and/or modified CDS sequence (AUadapt) from InfluenzaA__ALE31721__HA

SEQ ID NO: 13498 - RNA, 1701 nt, Artificial Sequence; identical to SEQ ID NO: 13466
  derived and/or modified CDS sequence (AUadapt) from InfluenzaA__ALE31722__HA

SEQ ID NO: 13499 - RNA, 1701 nt, Artificial Sequence
  derived and/or modified CDS sequence (AUadapt) from InfluenzaA__ALE31723__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccgcaagucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaccacgcccaacggcuccauccccaacgacaagccguuccagaacgugaaccggaucaccuacggggccugcccccgcuacgugaagcacucgacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13500 - RNA, 1701 nt, Artificial Sequence; identical to SEQ ID NO: 68
  derived and/or modified CDS sequence (AUadapt) from InfluenzaA__ALE31724__HA

SEQ ID NO: 13501 - RNA, 1701 nt, Artificial Sequence; identical to SEQ ID NO: 68
  derived and/or modified CDS sequence (AUadapt) from InfluenzaA__ALE31725__HA

SEQ ID NO: 13502 - RNA, 1701 nt, Artificial Sequence; identical to SEQ ID NO: 68
  derived and/or modified CDS sequence (AUadapt) from InfluenzaA__ALE31726__HA

SEQ ID NO: 13503 - RNA, 1701 nt, Artificial Sequence; identical to SEQ ID NO: 68
  derived and/or modified CDS sequence (AUadapt) from InfluenzaA__ALE31727__HA

SEQ ID NO: 13504 - RNA, 1701 nt, Artificial Sequence
  derived and/or modified CDS sequence (AUadapt) from InfluenzaA__ALE31728__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccauccccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13505 - RNA, 1701 nt, Artificial Sequence
  derived and/or modified CDS sequence (AUadapt) from InfluenzaA__ALE31729__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagaucaucgacggcgagaacugcacccugaucgacgcccuccugggggacccccagugcgacggcuuccagaacaagaagugggaccuguucguggagcgguccaaggccuacagcaacugcuaccccuacgacgugccggacuacgcgucccuccgcucgcuggucgccuccagcggcacccuggaguucaacaacgaguccuucaacuggacgggggugacccagaacggcaccucguccgccugcauccggcgcagcuccucguccuucuucagccggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccuccugaucaacuccaccgggaaccugaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccucaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13506 - RNA, 1701 nt, Artificial Sequence; identical to SEQ ID NO: 68
  derived and/or modified CDS sequence (AUadapt) from InfluenzaA__ALE31730__HA

SEQ ID NO: 13507 - RNA, 1701 nt, Artificial Sequence
  derived and/or modified CDS sequence (AUadapt) from InfluenzaA__ALE31731__HA
augaagaccaucaucgcccugucguacauccucugccagguguucgcccagaagauccccggcaacgacaacuccaccgcgacgcugugccuggggcaccacgccgucccgaacggcaccaucgugaagaccaucaccaacgaccgcaucgaggugacgaacgccaccgagcucguccagaacucguccaucggggagaucugcgacagcccccaccagauccuggacggcgagaacugcacccugaucgacgcccuccugggggacccccagugcgacggcuuccagaacaagaagugggaccuguucguggagcgguccaaggccuacucgaacugcuaccccuacgacgugccggacuacgcgucccuccgcagccuggucgccuccucgggcacccuggaguucaacaacgaguccuucaacuggacgggggugacccagaacggcaccagcuccgccugcauccgcaagucguccagcuccuucuucucgcggcucaacuggcugacccaccugaacuacacguaccccgcccucaacgugaccaugcccaacaacgagcaguucgacaagcuguacaucuggggcguccaccaccccgggaccgacaaggaccagaucuuccuguacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccuccugaucaacuccaccgggaaccugaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccucaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccucuggucguacaacgccgagcugcugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcugaaguccggcuacaaggacuggauccucuggaucucguucgccaucagcugcuuccugcugugcguggcccuccugggcuucaucaugugggccugccagaaggggaacauccgcugcaacaucugcaucuga

SEQ ID NO: 13508 - RNA, 1701 nt, Artificial Sequence; identical to SEQ ID NO: 13344
  derived and/or modified CDS sequence (AUadapt) from InfluenzaA__ALE31732__HA

SEQ ID NO: 13509 - RNA, 1701 nt, Artificial Sequence; identical to SEQ ID NO: 13344
  derived and/or modified CDS sequence (AUadapt) from InfluenzaA__ALE31733__HA

SEQ ID NO: 13510 - RNA, 1701 nt, Artificial Sequence
  derived and/or modified CDS sequence (AUadapt) from InfluenzaA__ALE31734__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccagcuccgccugcauccgcaagucguccagcuccuucuucucgcggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcuuccgcccccggauccgcgacauccccucgcggaucuccaucuacuggaccaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13511 - RNA, 1701 nt, Artificial Sequence; identical to SEQ ID NO: 13344
  derived and/or modified CDS sequence (AUadapt) from InfluenzaA__ALE31735__HA

SEQ ID NO: 13512 - RNA, 1701 nt, Artificial Sequence; identical to SEQ ID NO: 13243
  derived and/or modified CDS sequence (AUadapt) from InfluenzaA__ALE31736__HA

SEQ ID NO: 13513 - RNA, 1701 nt, Artificial Sequence; identical to SEQ ID NO: 13243
  derived and/or modified CDS sequence (AUadapt) from InfluenzaA__ALE31737__HA

SEQ ID NO: 13514 - RNA, 1701 nt, Artificial Sequence
  derived and/or modified CDS sequence (AUadapt) from InfluenzaA__ALE31738__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccucggggcgcaucaccgugagcaccaagggcucccagcaggccgugaucccgaacaucggcucgcggccccgcauccgggacauccccucccgcaucagcaucuacuggacgaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgccugcccccgguacgugaagcacagcacgcugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacccaggcggccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13515 - RNA, 1701 nt, Artificial Sequence; identical to SEQ ID NO: 68
  derived and/or modified CDS sequence (AUadapt) from InfluenzaA__ALE31739__HA

SEQ ID NO: 13516 - RNA, 1701 nt, Artificial Sequence
  derived and/or modified CDS sequence (AUadapt) from InfluenzaA__ALE31741__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucuccgagaucugcgacagcccccaccagauccucgacggcaagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucggggacccuggaguucaacgacgaguccuucaacugggccggcgugacgcagaacggcaccagcuccgccugcauccgggggucgaacuccagcuucuucucccgccugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccagagcuccggccggaucaccgugagcaccaagcgcucccagcaggccgugaucccgaacaucgggucgcggccccgcauccggaacauccccucccgcaucagcaucuacuggaccaucgucaagcccggcgacauccugcugaucaacuccacgggcaaccucaucgccccgcggggguacuucaagauccgcucgggcaaguccagcaucaugcgguccgacgcccccaucgggaagugcaagucggagugcaucacccccaacggcuccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacgggugggagggcaugaaggacggcugguacggguuccgccaccagaacuccgagggccgggggcaggccgcggaccucaagucgacccaggccgccaucgaccagaucaacggcaagcugaaccgccugaucgggaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggacguacgaccacgacguguaccgggacgaggcccugaacaaccgcuuccagaucaagggcguggagcucaagagcggguacaaggacuggauccuguggaucuccuucgccaucagcugcuuccugcucugcgucgcccugcugggcuucaucaugugggcgugccagaagggcaacauccggugcaacaucugcaucuga

SEQ ID NO: 13517 - RNA, 1701 nt, Artificial Sequence
  derived and/or modified CDS sequence (AUadapt) from InfluenzaA__ALE31742__HA
augaagaccaucaucgcccugucguacauccucugccugggcuucgcccagaagauccccgggaacgacaacuccaccgcgacgcugugccucggccaccacgccgugccgaacgggaccaucgucaagaccaucaccaacgaccgcaucgaggugacgaacgccaccgagcuggugcagaacucguccaucggcgagaucugcgacagcccccaccagauccuggacggggagaacugcacccucaucgacgcccugcugggcgacccccagugcgacggcuuccagaacaagaagugggaccucuucgucgagcgguccaaggccuacucgaacugcuaccccuacgacgugccggacuacgcgucccugcgcagccugguggccuccucggggacccucgaguucaacaacgaguccuucaacuggacgggcgucacccagaacgggaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccagcggccgcaucaccgucucgacgaagcggucccagcaggccgugaucccgaacaucggcagccgcccccggauccgcgacauccccucccggaucucgaucuacuggaccaucgugaagcccggggacauccugcugaucaacuccaccggcaaccucaucgccccgcgcggguacuucaagauccggagcggcaaguccucgaucaugcgcuccgacgcccccaucggcaagugcaagagcgagugcaucacccccaacggguccauccccaacgacaagccguuccagaacgucaaccgggugacguacggcgccugcccccgcuacgugaagcacucgacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucucguucgccaucagcugcuuccugcucugcguggcccugcugggguucaucaugugggccugccagaagggcaacauccgcugcaacaucugcaucuga

SEQ ID NO: 13518 - RNA, 1701 nt, Artificial Sequence; identical to SEQ ID NO: 13243
  derived and/or modified CDS sequence (AUadapt) from InfluenzaA__ALE31743__HA

SEQ ID NO: 13519 - RNA, 1701 nt, Artificial Sequence; identical to SEQ ID NO: 68
  derived and/or modified CDS sequence (AUadapt) from InfluenzaA__ALE31744__HA

SEQ ID NO: 13520 - RNA, 1701 nt, Artificial Sequence
  derived and/or modified CDS sequence (AUadapt) from InfluenzaA__ALE31745__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggucgcucgucgccuccagcggcacccuggaguucaacgacgaguccuucaacugggccggggugacgcagaacggcaccucguccgccugcauccgcgggagcaacuccucguucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccucgggccgcaucaccgugagcaccaagcggucccagcaggccgugaucccgaacaucggcucgcgccugcggauccgcaacauccccucccggaucagcaucuacuggaccaucgucaagcccggggacauccugcucaucaacuccacgggcaaccugaucgcgccccgcggguacuucaagauccagucgggcaaguccagcaucaugcgguccgacgccccgaucggcaagugcaagucggagugcaucacccccaacggguccauccccaacgacaagcccuuccagaacgugaacaagaucaccuacggcgccugcccgcgcuacgugaagcagagcacccugaagcucgccacggggaugcggaacguccccgagaagcagacccgcggcaucuucggggccaucgccggcuucaucgagaacggcugggaggggaugaaggacggcugguacggguuccggcaccagaacuccgagggccgcgggcaggccgcggaccucaagucgacccaggccgccaucgaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgggagaacgcggaggacaugggcaacgggugcuucaagaucuaccacaagugcgacaacgccugcaucggcucgauccgcaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggcgugccagaagggcaacauccgcugcaacaucugcaucuga

SEQ ID NO: 13521 - RNA, 1701 nt, Artificial Sequence
  derived and/or modified CDS sequence (AUadapt) from InfluenzaA__ALE31747__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagcggugggaccuguucguggagcgcuccaaggccuacucgaacugcuaccccuacgacgugccggacuacgcgucccugcggagccucgucgccuccucgggcacccuggaguucaacgacgaguccuucaacugggccggggugacgcagaacggcaccagcuccgccugcauccgcgggucgaacuccagcuucuucucccggcugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccaguccagcggccgcaucaccgugucgaccaagcggucccagcaggccgugaucccgaacaucggcagccgcccccggauccgcaacauccccucccggaucucgaucuacuggaccaucgucaagcccggggacauccugcugaucaacuccacgggcaaccucaucgccccgcgcggguacuucaagauccagagcggcaaguccucgaucaugcgguccgacgcccccaucggcaagugcaagagcgagugcaucacccccaacggguccauccccaacgacaagccguuccagaacgugaaccgcaucaccuacggcgcgugcccccgguacgugaagcagucgacccugaagcuggccacggggaugcgcaacguccccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcgggugcaggaccucgagaaguacgucgaggacacgaagaucgaccuguggucguacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcgucgagcucaaguccggcuacaaggacuggauccuguggaucucguucgccaucagcugcuuccugcucugcguggcccugcugggguucaucaugugggcgugccagaagggcaacauccggugcaacaucugcaucuga

SEQ ID NO: 13522 - RNA, 1701 nt, Artificial Sequence; identical to SEQ ID NO: 13243
  derived and/or modified CDS sequence (AUadapt) from InfluenzaA__ALE31748__HA

SEQ ID NO: 13523 - RNA, 1701 nt, Artificial Sequence; identical to SEQ ID NO: 68
  derived and/or modified CDS sequence (AUadapt) from InfluenzaA__ALE31749__HA

SEQ ID NO: 13524 - RNA, 1701 nt, Artificial Sequence; identical to SEQ ID NO: 13230
  derived and/or modified CDS sequence (AUadapt) from InfluenzaA__ALE31750__HA

SEQ ID NO: 13525 - RNA, 1701 nt, Artificial Sequence
  derived and/or modified CDS sequence (AUadapt) from InfluenzaA__ALE31751__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucgacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13526 - RNA, 1701 nt, Artificial Sequence; identical to SEQ ID NO: 68
  derived and/or modified CDS sequence (AUadapt) from InfluenzaA__ALE31752__HA

SEQ ID NO: 13527 - RNA, 1701 nt, Artificial Sequence; identical to SEQ ID NO: 13230
  derived and/or modified CDS sequence (AUadapt) from InfluenzaA__ALE31753__HA

SEQ ID NO: 13528 - RNA, 1701 nt, Artificial Sequence; identical to SEQ ID NO: 68
  derived and/or modified CDS sequence (AUadapt) from InfluenzaA__ALE31754__HA

SEQ ID NO: 13529 - RNA, 1701 nt, Artificial Sequence
  derived and/or modified CDS sequence (AUadapt) from InfluenzaA__ALE31755__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccagaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcgcucgaaggccuacuccaacugcuaccccuacgacgugccggacuacgcgagccugcggucccucgucgccucguccggcacccuggaguucaacgacgagagcuucaacugggccggcgugacgcagaacgggaccuccucggccugcauccgcggcuccaacagcuccuucuucucgcggcugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcgcaucaccguguccaccaagcggagccagcaggccgugaucccgaacaucggcucccgcccccggauccgcaacauccccucgcggaucuccaucuacuggaccaucgucaagcccggcgacauccugcugaucaacagcacggggaaccucaucgccccgcgcggcuacuucaagauccgguccgggaaguccuccaucaugcgcucggacgcccccaucggcaagugcaaguccgagugcaucacccccaacggcagcauccccaacgacaagccguuccagaacgugaaccggaucaccuacggggcgugcccccgcuacgugaagcaguccacccugaagcuggccacgggcaugcggaacguccccgagaagcagacccgcgggaucuucggcgccaucgccggguucaucgagaacggcugggagggcaugaaggacgggugguacggcuuccggcaccagaacucggaggggcgcggccaggccgcggaccucaaguccacccaggccgccaucgaccagaucaacgggaagcugaaccggcugaucggcaagaccaacgagaaguuccaccagaucgagaaggaguucagcgagguggagggccgcauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagcuccgggagaacgcggaggacauggggaacggcugcuucaagaucuaccacaagugcgacaacgccugcaucggguccauccgcaacggcacguacgaccacaacguguaccgcgacgaggcccugaacaaccgguuccagaucaaggggguggagcucaagagcggcuacaaggacuggauccuguggaucagcuucgccaucuccugcuuccugcucugcgucgcccugcugggcuucaucaugugggcgugccagaaggggaacauccgcugcaacaucugcaucuga

SEQ ID NO: 13530 - RNA, 1701 nt, Artificial Sequence; identical to SEQ ID NO: 13230
  derived and/or modified CDS sequence (AUadapt) from InfluenzaA__ALE31756__HA

SEQ ID NO: 13531 - RNA, 1701 nt, Artificial Sequence; identical to SEQ ID NO: 68
  derived and/or modified CDS sequence (AUadapt) from InfluenzaA__ALE31757__HA

SEQ ID NO: 13532 - RNA, 1701 nt, Artificial Sequence
  derived and/or modified CDS sequence (AUadapt) from InfluenzaA__ALE31758__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucguggccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13533 - RNA, 1701 nt, Artificial Sequence
  derived and/or modified CDS sequence (AUadapt) from InfluenzaA__ALE31759__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagcggugggaccuguucguggagcgcuccaaggccuacucgaacugcuaccccuacgacgugccggacuacgcgucccugcggagccucgucgccuccucgggcacccuggaguucaacgacgaguccuucaacugggccggggugacgcagaacggcaccagcuccgccugcauccgcgggucgaacuccagcuucuucucccggcugaacuggcucacccacucgaacuucaaguaccccgcgcugaacgugaccaugcccaacaacgagcaguucgacaagcuguacaucuggggcguccaccaccccgggacggacaaggaccagaucuuccucuacgcccaguccagcggccgcgugaccgugucgaccaagcggucccagcaggccgucaucccgaacaucggcagccgcccccggauccgcaacauccccucccggaucucgaucuacuggaccaucgugaagcccggggacauccugcugaucaacuccacgggcaaccucaucgccccgcgcggguacuucaagauccagagcggcaaguccucgaucaugcgguccgacgcccccaucggcaagugcaagagcgagugcaucacccccaacggguccauccccaacaacaagccguuccagaacgugaaccgcaucaccuacggcgcgugcccccgguacgucaagcagucgacccugaagcuggccacggggaugcgcaacgugcccgagaagcagacccggggcaucuucggggccaucgccggcuucaucgagaacggcugggaggggaugaaggacggcugguacggguuccgccaccagaacuccgagggccgggggcaggccgcggaccucaagagcacccaggccgccaucgaccagaucaacggcaagcugaaccgccugaucggcaagaccaacgagaaguuccaccagaucgagaaggaguucuccgagguggaggggcggauccaggaccucgagaaguacgucgaggacacgaagaucgaccuguggucguacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcagcauccgcaacgggacguacgaccacgacguguaccgggacgaggcccugaacaaccgcuuccagaucaagggcgucgagcucaaguccggcuacaaggacuggauccuguggaucucguucgccaucagcugcuuccugcucugcguggcccugcugggguucaucaugugggcgugccagaagggcaacauccggugcaacaucugcaucuga

SEQ ID NO: 13534 - RNA, 1701 nt, Artificial Sequence
  derived and/or modified CDS sequence (AUadapt) from InfluenzaA__ALE31760__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcuaccgcccccggauccgcgacauccccagccggaucuccaucuacuggaccaucgucaagcccggcgacauccugcugaucaacucgaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacgccaagaucgaccugugguccuacaacgccgagcugcucguggcccuggagaaccagcacaccaucgaccugaccgacucggagaugaacaagcuguucgagaagacgaagaagcagcuccgcgagaacgcggaggacauggggaacggcugcuucaagaucuaccacaagugcgacaacgccugcaucggguccauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggcgugccagaaggggaacauccgcugcaacaucugcaucuga

SEQ ID NO: 13535 - RNA, 1701 nt, Artificial Sequence; identical to SEQ ID NO: 13230
  derived and/or modified CDS sequence (AUadapt) from InfluenzaA__ALE31761__HA

SEQ ID NO: 13536 - RNA, 1701 nt, Artificial Sequence; identical to SEQ ID NO: 68
  derived and/or modified CDS sequence (AUadapt) from InfluenzaA__ALE31762__HA

SEQ ID NO: 13537 - RNA, 1701 nt, Artificial Sequence; identical to SEQ ID NO: 13292
  derived and/or modified CDS sequence (AUadapt) from InfluenzaA__ALE31763__HA

SEQ ID NO: 13538 - RNA, 1701 nt, Artificial Sequence; identical to SEQ ID NO: 13344
  derived and/or modified CDS sequence (AUadapt) from InfluenzaA__ALE31764__HA

SEQ ID NO: 13539 - RNA, 1701 nt, Artificial Sequence; identical to SEQ ID NO: 68
  derived and/or modified CDS sequence (AUadapt) from InfluenzaA__ALE31765__HA

SEQ ID NO: 13540 - RNA, 1701 nt, Artificial Sequence
  derived and/or modified CDS sequence (AUadapt) from InfluenzaA__ALE31774__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagguguuccucuacgcgcaguccucggggcgcaucaccgugagcacgaagcggucccagcaggccgucaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13541 - RNA, 1701 nt, Artificial Sequence
  derived and/or modified CDS sequence (AUadapt) from InfluenzaA__ALE31775__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgaguuccugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13542 - RNA, 1701 nt, Artificial Sequence
  derived and/or modified CDS sequence (AUadapt) from InfluenzaA__ALE31776__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcagcgggcggaucaccguguccaccaagcgcucgcagcaggccgugaucccgaacaucggcucccggccccgcauccggaacauccccagccgcaucuccaucuacuggaccaucgucaagcccggcgacauccugcugaucaacucgacggggaaccucaucgccccgcggggcuacuucaagauccgcuccgggaaguccuccaucaugcggagcgacgccuccaucggcaagugcaagucggagugcaucacccccaacggcuccauccccaacgacaagcccuuccagaacgugaaccgcaucaccuacggggcgugcccgcgguacgugaagcagagcacccugaagcuggccacgggcaugcgcaacguccccgagaagcagacccgggggaucuucggcgccaucgccggguucaucgagaacggcugggagggcaugaaggacgggugguacggcuuccgccaccagaacuccgaggggcggggccaggccgcggaccucaagucgacccaggccgccaucgaccagaucaacgggaagcugaaccgccugaucggcaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgcggaggacauggggaacggcugcuucaagaucuaccacaagugcgacaacgccugcaucgggucgauccgcaacggcacguacgaccacgacguguaccgggacgaggcccugaacaaccgcuuccagaucaaggggguggagcucaagagcggcuacaaggacuggauccuguggaucuccuucgccaucagcugcuuccugcucugcgucgcccugcugggcuucaucaugugggcgugccagaaggggaacauccggugcaacaucugcaucuga

SEQ ID NO: 13543 - RNA, 1701 nt, Artificial Sequence
  derived and/or modified CDS sequence (AUadapt) from InfluenzaA__ALE31777__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccguggucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13544 - RNA, 1701 nt, Artificial Sequence; identical to SEQ ID NO: 13292
  derived and/or modified CDS sequence (AUadapt) from InfluenzaA__ALE31778__HA

SEQ ID NO: 13545 - RNA, 1701 nt, Artificial Sequence; identical to SEQ ID NO: 68
  derived and/or modified CDS sequence (AUadapt) from InfluenzaA__ALE31779__HA

SEQ ID NO: 13546 - RNA, 1701 nt, Artificial Sequence
  derived and/or modified CDS sequence (AUadapt) from InfluenzaA__ALE31780__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggcccacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcaccgacgcccccaucggcaagugcaaguccgagugcaucacgcccaacggcucgauccccaacgacaagccguuccagaacgugaaccggaucaccuacggggccugcccccgcuacgugaagcacuccacccugaagcuggcgaccggcaugcggaacguccccgagaagcagacgcgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13547 - RNA, 1701 nt, Artificial Sequence
  derived and/or modified CDS sequence (AUadapt) from InfluenzaA__ALE31781__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcggcucgccccaccagauccuggacggggagaacugcacccucaucgacgcccugcugggcgacccccagugcgacggcuuccagaacaagaagugggaccucuucguggagcgguccaaggccuacagcaacugcuaccccuacgacgugccggacuacgcgucccugcgcucgcuggucgccuccagcgggacccucgaguucaacaacgaguccuucaacuggacgggcgugacccagaacgggaccucguccgccugcauccgcaagagcuccucguccuucuucagcaagcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucgggccggaucaccgugagcacgaagcgcucccagcaggccgugaucccgaacaucggcucgcggccccgcauccgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13548 - RNA, 1701 nt, Artificial Sequence
  derived and/or modified CDS sequence (AUadapt) from InfluenzaA__ALE31782__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgucucccugcgcucgcugguggcguccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcccaguccagcgggcgcaucaccgugucgacgaagcggucccagcaggcggucaucccgaacaucggcagccgcccccggauccgcgacauccccucccggaucucgaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcagagcacccugaagcuggccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagucgacgcaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacgucuaccgcgacgaggcgcugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13549 - RNA, 1701 nt, Artificial Sequence
  derived and/or modified CDS sequence (AUadapt) from InfluenzaA__ALE31783__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccguccccaacaacgagcaguucgacaagcuguacaucuggggcgugcaccaccccgggaccgacaaggaccagaucuuccucuacgcgcaguccucggggcgcaucaccgugagcacgaagcggucccagcaggccgucaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13550 - RNA, 1701 nt, Artificial Sequence; identical to SEQ ID NO: 13302
  derived and/or modified CDS sequence (AUadapt) from InfluenzaA__ALE31784__HA

SEQ ID NO: 13551 - RNA, 1701 nt, Artificial Sequence; identical to SEQ ID NO: 68
  derived and/or modified CDS sequence (AUadapt) from InfluenzaA__ALE31785__HA

SEQ ID NO: 13552 - RNA, 1701 nt, Artificial Sequence; identical to SEQ ID NO: 13292
  derived and/or modified CDS sequence (AUadapt) from InfluenzaA__ALE31786__HA

SEQ ID NO: 13553 - RNA, 1701 nt, Artificial Sequence; identical to SEQ ID NO: 13344
  derived and/or modified CDS sequence (AUadapt) from InfluenzaA__ALE31787__HA

SEQ ID NO: 13554 - RNA, 1701 nt, Artificial Sequence; identical to SEQ ID NO: 12786
  derived and/or modified CDS sequence (AUadapt) from InfluenzaA__ALE31788__HA

SEQ ID NO: 13555 - RNA, 1701 nt, Artificial Sequence; identical to SEQ ID NO: 68
  derived and/or modified CDS sequence (AUadapt) from InfluenzaA__ALE31789__HA

SEQ ID NO: 13556 - RNA, 1701 nt, Artificial Sequence; identical to SEQ ID NO: 13301
  derived and/or modified CDS sequence (AUadapt) from InfluenzaA__ALE31790__HA

SEQ ID NO: 13557 - RNA, 1701 nt, Artificial Sequence; identical to SEQ ID NO: 13422
  derived and/or modified CDS sequence (AUadapt) from InfluenzaA__ALE31791__HA

SEQ ID NO: 13558 - RNA, 1701 nt, Artificial Sequence; identical to SEQ ID NO: 13322
  derived and/or modified CDS sequence (AUadapt) from InfluenzaA__ALE31792__HA

SEQ ID NO: 13559 - RNA, 1701 nt, Artificial Sequence
  derived and/or modified CDS sequence (AUadapt) from InfluenzaA__ALE31793__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucucccucuacgcgcagagcucggggcgcaucaccguguccacgaagcggagccagcaggccgugaucccgaacaucggcucccgcccccggauccgcgacauccccucgcggaucuccaucuacuggaccaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13560 - RNA, 1701 nt, Artificial Sequence; identical to SEQ ID NO: 68
  derived and/or modified CDS sequence (AUadapt) from InfluenzaA__ALE31794__HA

SEQ ID NO: 13561 - RNA, 1701 nt, Artificial Sequence; identical to SEQ ID NO: 68
  derived and/or modified CDS sequence (AUadapt) from InfluenzaA__ALE31795__HA

SEQ ID NO: 13562 - RNA, 1701 nt, Artificial Sequence; identical to SEQ ID NO: 68
  derived and/or modified CDS sequence (AUadapt) from InfluenzaA__ALE31796__HA

SEQ ID NO: 13563 - RNA, 1701 nt, Artificial Sequence; identical to SEQ ID NO: 13344
  derived and/or modified CDS sequence (AUadapt) from InfluenzaA__ALE31797__HA

SEQ ID NO: 13564 - RNA, 1701 nt, Artificial Sequence; identical to SEQ ID NO: 13344
  derived and/or modified CDS sequence (AUadapt) from InfluenzaA__ALE31798__HA

SEQ ID NO: 13565 - RNA, 1701 nt, Artificial Sequence; identical to SEQ ID NO: 68
  derived and/or modified CDS sequence (AUadapt) from InfluenzaA__ALE31799__HA

SEQ ID NO: 13566 - RNA, 1701 nt, Artificial Sequence; identical to SEQ ID NO: 13292
  derived and/or modified CDS sequence (AUadapt) from InfluenzaA__ALE31800__HA

SEQ ID NO: 13567 - RNA, 1701 nt, Artificial Sequence; identical to SEQ ID NO: 68
  derived and/or modified CDS sequence (AUadapt) from InfluenzaA__ALE31801__HA

SEQ ID NO: 13568 - RNA, 1701 nt, Artificial Sequence; identical to SEQ ID NO: 68
  derived and/or modified CDS sequence (AUadapt) from InfluenzaA__ALE31802__HA

SEQ ID NO: 13569 - RNA, 1701 nt, Artificial Sequence; identical to SEQ ID NO: 13292
  derived and/or modified CDS sequence (AUadapt) from InfluenzaA__ALE31803__HA

SEQ ID NO: 13570 - RNA, 1701 nt, Artificial Sequence; identical to SEQ ID NO: 13243
  derived and/or modified CDS sequence (AUadapt) from InfluenzaA__ALE31805__HA

SEQ ID NO: 13571 - RNA, 1701 nt, Artificial Sequence
  derived and/or modified CDS sequence (AUadapt) from InfluenzaA__ALE31806__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacacccugcugaucaacuccaccgggaaccucaucgccccgcgcggcuacuucaagauccggagcgggaaguccucgaucaugcgcuccgacgcccccaucggcaagugcaagagcgagugcaucacgcccaacggcuccauccccaacgacaagccguuccagaacgugaaccggaucaccuacggggccugcccccgcuacgugaagcacucgacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13572 - RNA, 1701 nt, Artificial Sequence
  derived and/or modified CDS sequence (AUadapt) from InfluenzaA__ALE31807__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacuggacgggggugacccagaacggcaccucguccgccugcauccggcgcagcuccagcuccuucuucucgcggcugaacuggcucacccaccugaacuucacguaccccgcccugaacgugaccaugcccaacaacgagcaguucgacaagcucuacgucuggggcgugcaccaccccgggaccgacaaggaccagaucuuccuguacgcgcaguccagcgggcgcaucaccgugucgacgaagcggucccagcaggccgucaucccgaacaucggcagccgcccccggauccgcaacauccccucccggaucucgaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcucgcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacaacgucuaccgcgacgaggcccucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13573 - RNA, 1701 nt, Artificial Sequence
  derived and/or modified CDS sequence (AUadapt) from InfluenzaA__ALE31808__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13574 - RNA, 1701 nt, Artificial Sequence; identical to SEQ ID NO: 68
  derived and/or modified CDS sequence (AUadapt) from InfluenzaA__ALE31810__HA

SEQ ID NO: 13575 - RNA, 1701 nt, Artificial Sequence; identical to SEQ ID NO: 68
  derived and/or modified CDS sequence (AUadapt) from InfluenzaA__ALE31812__HA

SEQ ID NO: 13576 - RNA, 1701 nt, Artificial Sequence
  derived and/or modified CDS sequence (AUadapt) from InfluenzaA__ALE31814__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcaagaacugcacccugaucgacgcccugcucggggacccccagugcgacggcuuccagaacaagaagugggaccuguucguggagcgguccaaggcccacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacucguccuucuucagccgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgucgggccggaucaccgugagcaccaagcgcucccagcaggccgugauccccaacaucggcucgcggccccgcauccgggacauccccucccgcaucagcaucuacuggaccaucgucaagccgggggacauccugcucaucaacuccacgggcaaccugaucgcgccccggggguacuucaagauccgcucgggcaaguccucgaucaugcgguccgacgcccccaucggcaagugcaagagcgagugcaucacccccaacggguccaucccgaacgacaagcccuuccagaacgugaaccgcaucaccuacggcgccugcccccgguacgugaagcagucgacccugaagcucgccacggggaugcgcaacguccccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcgucgagcugaaguccggcuacaaggacuggauccuguggaucucguucgccaucagcugcuuccuccugugcguggcccugcucggguucaucaugugggccugccagaagggcaacauccgcugcaacaucugcaucuga

SEQ ID NO: 13577 - RNA, 1701 nt, Artificial Sequence; identical to SEQ ID NO: 13576
  derived and/or modified CDS sequence (AUadapt) from InfluenzaA__ALE31815__HA

SEQ ID NO: 13578 - RNA, 1701 nt, Artificial Sequence; identical to SEQ ID NO: 68
  derived and/or modified CDS sequence (AUadapt) from InfluenzaA__ALE31818__HA

SEQ ID NO: 13579 - RNA, 1701 nt, Artificial Sequence
  derived and/or modified CDS sequence (AUadapt) from InfluenzaA__ALE31819__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgggggagcuccucguccuucuucagccgccugaacuggcugacccaccucaacuacacguaccccgcccugaacgugaccaugcccaacaaggagcaguucgacaagcuguacaucuggggcguccaccaccccgggaccgacaaggaccagaucuuccucuacgcgcaguccucgggccggaucaccgugagcacgaagcgcucccagcaggccgugaucccgaacaucggcucgcggccccgcauccgggacauccccucccgcaucagcaucuacuggaccaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13580 - RNA, 1701 nt, Artificial Sequence; identical to SEQ ID NO: 13230
  derived and/or modified CDS sequence (AUadapt) from InfluenzaA__ALE31820__HA

SEQ ID NO: 13581 - RNA, 1701 nt, Artificial Sequence
  derived and/or modified CDS sequence (AUadapt) from InfluenzaA__ALE31821__HA
augaagaccaucaucgcccugucguacacccucugccugguguucgcccagaagauccccggcaacgacaacuccacggcgacccugugccucgggcaccacgccgucccgaacggcaccaucgugaagaccaucacgaacgaccgcaucgaggugaccaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggcccacucgaacugcuaccccuacgacgugccggacuacgcgucccugcgcagccuggucgccuccucgggcacgcucgaguucaacaacgaguccuucaacuggaccggggugacccagaacggcaccagcuccgccugcauccggcgcucguccucguccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcgcaguccucggggcgcaucacggugagcaccaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccucgaucaugcgcuccgacgcccccaucggcaagugcaagagcgagugcaucacgcccaacggcuccauccccaacgacaagccguuccagaacgugaaccggaucaccuacggggccugcccccgcuacgugaagcacucgacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13582 - RNA, 1701 nt, Artificial Sequence; identical to SEQ ID NO: 13322
  derived and/or modified CDS sequence (AUadapt) from InfluenzaA__ALE31822__HA

SEQ ID NO: 13583 - RNA, 1701 nt, Artificial Sequence; identical to SEQ ID NO: 13230
  derived and/or modified CDS sequence (AUadapt) from InfluenzaA__ALE31823__HA

SEQ ID NO: 13584 - RNA, 1701 nt, Artificial Sequence; identical to SEQ ID NO: 68
  derived and/or modified CDS sequence (AUadapt) from InfluenzaA__ALE31824__HA

SEQ ID NO: 13585 - RNA, 1701 nt, Artificial Sequence
  derived and/or modified CDS sequence (AUadapt) from InfluenzaA__ALE31825__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuaccgcuaccccgcccugaacgugacgaugcccaacaacgagcaguucgacaagcuguacaucuggggcguccaccaccccgggaccgacaaggaccagaucuuccucuacgcgcaguccucggggcggaucaccgugagcaccaagcgcucccagcaggccgugaucccgaacaucggcucgcggccccgcauccgggacauccccucccgcaucagcaucuacuggacgaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucaccuacggggccugcccccgguacgugaagcacagcacgcugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgggagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13586 - RNA, 1701 nt, Artificial Sequence; identical to SEQ ID NO: 68
  derived and/or modified CDS sequence (AUadapt) from InfluenzaA__ALE31826__HA

SEQ ID NO: 13587 - RNA, 1701 nt, Artificial Sequence; identical to SEQ ID NO: 68
  derived and/or modified CDS sequence (AUadapt) from InfluenzaA__ALE31827__HA

SEQ ID NO: 13588 - RNA, 1701 nt, Artificial Sequence; identical to SEQ ID NO: 68
  derived and/or modified CDS sequence (AUadapt) from InfluenzaA__ALE31828__HA

SEQ ID NO: 13589 - RNA, 1701 nt, Artificial Sequence; identical to SEQ ID NO: 13243
  derived and/or modified CDS sequence (AUadapt) from InfluenzaA__ALE31829__HA

SEQ ID NO: 13590 - RNA, 1701 nt, Artificial Sequence
  derived and/or modified CDS sequence (AUadapt) from InfluenzaA__ALE31830__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgacaucacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13591 - RNA, 1701 nt, Artificial Sequence
  derived and/or modified CDS sequence (AUadapt) from InfluenzaA__ALE31832__HA
augaagaacaucaucgcccugucguacauccucugccugguguucgcccagaagauccccggcaacgacaacuccaccgcgacccugugccucgggcaccacgccgucccgaacggcacgaucgugaagaccaucaccaacgaccgcaucgaggugaccaacgccacggagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggaccggggugacgcagaacggcaccucguccgccugcauccggcgcagcaacuccucguucuucucccggcugaacuggcugacccaccucaacuacaccuaccccgcccugaacgugacgaugcccaacaacgagcaguucgacaagcuguacaucuggggcguccaccaccccgggaccgacaaggaccagaucuuccucuacgcgcagagcuccgggcgcaucaccgugucgaccaagcggagccagcaggccgugaucccgaacaucggcucccgcccccggauccgcgacauccccucgcggaucuccaucuacuggacgaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucaccuacggggccugcccccgcuacgugaagcacuccacgcugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacccaggcggccaucgaccagaucaacgggaagcugaaccggcugaucggcaagacgaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13592 - RNA, 1701 nt, Artificial Sequence
  derived and/or modified CDS sequence (AUadapt) from InfluenzaA__ALE31833__HA
augaagaccaucaucgcccugucguacauccucugccugguguccgcccagaagauccccggcaacgacaacucgaccgcgacgcugugccucgggcaccacgccgucccgaacggcaccaucgugaagaccaucaccaacgaccgcaucgaggugacgaacgccaccgagcugguccagaacuccagcaucggggagaucugcaacucgccccaccagauccuggacggcgagaacugcacccucaucgacgcccugcugggggacccccagugcgacggcuuccagaacaagaagugggaccucuucguggagcggagcaaggccuacuccaacugcuaccccuacgacgugccggacuacgcgucgcugcgcucccuggucgccagcuccggcacccucgaguucaacaacgagucguucaacuggacgggggugacccagaacggcaccuccagcgccugcauccggcgcuccucguccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagucgagcgggcgcaucaccguguccacgaagcggucgcagcaggccgugaucccgaacaucggcucccgcccccggauccgcgacauccccagccggaucuccaucuacuggaccaucgucaagcccggcgacauccugcugaucaacucgaccgggaaccucaucgccccgcgcggcuacuucaagauccgguccgggaaguccuccaucaugcgcagcgacgcccccaucggcaagugcaaguccgagugcaucacccccaacggcucgauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13593 - RNA, 1701 nt, Artificial Sequence
  derived and/or modified CDS sequence (AUadapt) from InfluenzaA__ALE31834__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggcccacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagagcucgggccggaucaccguguccaccaagcgcagccagcaggccgugaucccgaacaucggcucccggccccgcauccgggacauccccucgcgcaucuccaucuacuggaccaucgucaagcccggggacauccugcucaucaacagcacgggcaaccugaucgccccgcggggguacuucaagauccgcuccggcaagucguccaucaugcggagcgacgcccccaucggcaagugcaaguccgagugcaucacccccaacgggucgauccccaacgacaagccguuccagaacgugaaccgcaucaccuacggcgccugcccccgguacgugaagcaguccacccugaagcucgcgacggggaugcgcaacguccccgagaagcagacccggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucucggagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcucaagucgggcuacaaggacuggauccuguggaucagcuucgccaucuccugcuuccugcugugcguggcccugcucggguucaucaugugggccugccagaagggcaacauccggugcaacaucugcaucuga

SEQ ID NO: 13594 - RNA, 1701 nt, Artificial Sequence; identical to SEQ ID NO: 13344
  derived and/or modified CDS sequence (AUadapt) from InfluenzaA__ALE31835__HA

SEQ ID NO: 13595 - RNA, 1701 nt, Artificial Sequence; identical to SEQ ID NO: 68
  derived and/or modified CDS sequence (AUadapt) from InfluenzaA__ALE31836__HA

SEQ ID NO: 13596 - RNA, 1701 nt, Artificial Sequence
  derived and/or modified CDS sequence (AUadapt) from InfluenzaA__ALE31837__HA
augaagaccaucaucgcccugucguacauccucugccugguguacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13597 - RNA, 1701 nt, Artificial Sequence; identical to SEQ ID NO: 68
  derived and/or modified CDS sequence (AUadapt) from InfluenzaA__ALE31838__HA

SEQ ID NO: 13598 - RNA, 1701 nt, Artificial Sequence; identical to SEQ ID NO: 68
  derived and/or modified CDS sequence (AUadapt) from InfluenzaA__ALE31839__HA

SEQ ID NO: 13599 - RNA, 1701 nt, Artificial Sequence
  derived and/or modified CDS sequence (AUadapt) from InfluenzaA__ALE31840__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgccugcggauccgcgacauccccucccggaucucgaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaagucggagugcaucacccccaacggcuccauccccaacgacaagcccuuccagaacgugaaccggaucacguacggggccugcccgcgcuacgugaagcacagcacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13600 - RNA, 1701 nt, Artificial Sequence; identical to SEQ ID NO: 68
  derived and/or modified CDS sequence (AUadapt) from InfluenzaA__ALE31842__HA

SEQ ID NO: 13601 - RNA, 1701 nt, Artificial Sequence
  derived and/or modified CDS sequence (AUadapt) from InfluenzaA__ALE31843__HA
augcagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugucgacgaagcgcucccagcaggccgugaucccgaacaucggcagccggccccgcauccgggacauccccucccgcaucucgaucuacuggaccaucgucaagcccggcgacauccugcugaucaacuccaccgggaaccucaucgccccgcggggcuacuucaagauccugagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13602 - RNA, 1701 nt, Artificial Sequence; identical to SEQ ID NO: 13243
  derived and/or modified CDS sequence (AUadapt) from InfluenzaA__ALE31844__HA

SEQ ID NO: 13603 - RNA, 1701 nt, Artificial Sequence; identical to SEQ ID NO: 13219
  derived and/or modified CDS sequence (AUadapt) from InfluenzaA__ALE31846__HA

SEQ ID NO: 13604 - RNA, 1701 nt, Artificial Sequence; identical to SEQ ID NO: 68
  derived and/or modified CDS sequence (AUadapt) from InfluenzaA__ALE31847__HA

SEQ ID NO: 13605 - RNA, 1701 nt, Artificial Sequence; identical to SEQ ID NO: 68
  derived and/or modified CDS sequence (AUadapt) from InfluenzaA__ALE31848__HA

SEQ ID NO: 13606 - RNA, 1701 nt, Artificial Sequence
  derived and/or modified CDS sequence (AUadapt) from InfluenzaA__ALE31850__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggggugacgcagaacggcaccagcuccucgugcauccggggguccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcggccggaucaccgugucgaccaagcgcucccagcaggccgugauccccaacaucggcagccggccccgcauccgggacauccccucccgcaucucgaucuacuggaccaucgucaagccgggggacauccugcucaucaacuccacgggcaaccugaucgcgccccggggguacuucaagauccgcagcggcaaguccucgaucaugcgguccgacgcccccaucggcaagugcaagagcgagugcaucacccccaacggguccaucccgaacgacaagcccuuccagaacgugaaccgcgugaccuacggcgccugcccccgguacgucaagcagucgacccugaagcucgccacggggaugcgcaacgugcccgagcggcagacccgcggcaucuucggggccaucgccggcuucaucgagaacggcugggaggggaugguggacggcugguacggguuccggcaccagaacuccgagggccgcgggcaggccgccgaccucaagagcacccaggcggccaucgaccagaucaacggcaagcugaaccggcugaucggcaagaccaacgagaaguuccaccagaucgagaaggaguucuccgaggucgaggggcgcauccaggaccuggagaaguacguggaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacgucuaccgcgacgaggcccucaacaaccgguuccagaucaagggcguggagcugaaguccggcuacaaggacuggauccuguggaucucguucgccaucagcugcuuccuccugugcguggcccugcucggguucaucaugugggccugccagaagggcaacauccgcugcaacaucugcaucuga

SEQ ID NO: 13607 - RNA, 1701 nt, Artificial Sequence
  derived and/or modified CDS sequence (AUadapt) from InfluenzaA__ALE31851__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaucgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13608 - RNA, 1701 nt, Artificial Sequence; identical to SEQ ID NO: 13230
  derived and/or modified CDS sequence (AUadapt) from InfluenzaA__ALE31852__HA

SEQ ID NO: 13609 - RNA, 1701 nt, Artificial Sequence
  derived and/or modified CDS sequence (AUadapt) from InfluenzaA__ALE31853__HA
augaagaccaucaucgcccugucguacauccucugccugguguucacccagaagauccccggcaacgacaacuccacggccacccugugccucgggcaccacgcggucccgaacggcaccaucgugaagaccaucacgaacgaccgcaucgaggugaccaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgccucccugcgcucgcuggucgcguccagcggcacgcucgaguucaacaacgaguccuucaacuggaccggggugacccagaacggcaccucguccgccugcauccggcgcagcuccucguccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcccaguccucggggcgcaucacggugagcaccaagcggucccagcaggcggugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacgcccaacggcuccauccccaacgacaagccguuccagaacgugaaccggaucaccuacggggccugcccccgcuacgugaagcacagcacccugaagcuggccaccggcaugcggaacguccccgagaagcagacgcgcgggaucuucggcgcgaucgccggguucaucgagaacggcugggagggcaugguggacgggugguacggcuuccggcaccagaacuccgaggggcgcggccaggccgccgaccucaagucgacccaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13610 - RNA, 1701 nt, Artificial Sequence
  derived and/or modified CDS sequence (AUadapt) from InfluenzaA__ALE31854__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccucggggcggaucaccgugagcacgaagggcucccagcaggccgugaucccgaacaucggcucgcgcccccggauccgcgacauccccucccggaucagcaucuacuggaccaucgucaagcccggggacauccugcugaucaacuccaccggcaaccucaucgccccgcgcggguacuucaagauccggucgggcaaguccagcaucaugcgcuccgacgcccccaucggccggugcaagucggagugcaucacccccaacggguccauccccaacgacaagccguuccagaacgugaaccgcaucacguacggcgccugcccccgguacgugaagcacagcacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13611 - RNA, 1701 nt, Artificial Sequence; identical to SEQ ID NO: 13372
  derived and/or modified CDS sequence (AUadapt) from InfluenzaA__ALE31855__HA

SEQ ID NO: 13612 - RNA, 1701 nt, Artificial Sequence; identical to SEQ ID NO: 68
  derived and/or modified CDS sequence (AUadapt) from InfluenzaA__ALE31856__HA

SEQ ID NO: 13613 - RNA, 1701 nt, Artificial Sequence; identical to SEQ ID NO: 68
  derived and/or modified CDS sequence (AUadapt) from InfluenzaA__ALE31857__HA

SEQ ID NO: 13614 - RNA, 1701 nt, Artificial Sequence
  derived and/or modified CDS sequence (AUadapt) from InfluenzaA__ALE31858__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13615 - RNA, 1701 nt, Artificial Sequence
  derived and/or modified CDS sequence (AUadapt) from InfluenzaA__ALE31859__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcacccggcgcucguccagcuccuucuucucgcggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcgcaguccagcgggcgcaucacggugucgaccaagcggucccagcaggccgugaucccgaacaucggcagccgcccccggauccgcgacauccccucccggaucucgaucuacuggaccaucgucaagcccggcgacaugcugcugaucaacuccaccgggaaccucaucgccccgcgcggcuacuucaagauccggagcgggaaguccucgaucaugcgcuccgacgcccccaucggcaagugcaagagcgagugcaucacgcccaacggcuccauccccaacgacaagccguuccagaacgugaaccggaucaccuacggggccugcccccgcuacgugaagcacucgacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13616 - RNA, 1701 nt, Artificial Sequence
  derived and/or modified CDS sequence (AUadapt) from InfluenzaA__ALE31860__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucgggaagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucgggggaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13617 - RNA, 1701 nt, Artificial Sequence; identical to SEQ ID NO: 68
  derived and/or modified CDS sequence (AUadapt) from InfluenzaA__ALE31861__HA

SEQ ID NO: 13618 - RNA, 1701 nt, Artificial Sequence
  derived and/or modified CDS sequence (AUadapt) from InfluenzaA__ALE31862__HA
augaagaugaucaucgcccugucguacauccucugccugguguucgcccagaagauccccggcaacgacaacuccaccgcgacccugugccucgggcaccacgccgucccgaacggcacgaucgugaagaccaucaccaacgaccgcaucgaggugaccaacgccacggagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccucgggcacccucgaguucaacaacgaguccuucaacuggaccggggugacgcagaacggcaccagcuccgccugcauccgcaagucguccagcuccuucuucagccggcugaacuggcugacccaccucaacuacaccuaccccgcccugaacgugacgaugcccaacaacgagcaguucgacaagcuguacaucuggggcguccaccaccccgggaccgacaaggaccagaucuuccucuacgcgcgguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucaccuacggggccugcccccgcuacgugaagcacucgacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgaguuccugguggcccucgagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13619 - RNA, 1701 nt, Artificial Sequence; identical to SEQ ID NO: 13344
  derived and/or modified CDS sequence (AUadapt) from InfluenzaA__ALE31863__HA

SEQ ID NO: 13620 - RNA, 1701 nt, Artificial Sequence; identical to SEQ ID NO: 13344
  derived and/or modified CDS sequence (AUadapt) from InfluenzaA__ALE31865__HA

SEQ ID NO: 13621 - RNA, 1701 nt, Artificial Sequence; identical to SEQ ID NO: 13344
  derived and/or modified CDS sequence (AUadapt) from InfluenzaA__ALE31866__HA

SEQ ID NO: 13622 - RNA, 1701 nt, Artificial Sequence
  derived and/or modified CDS sequence (AUadapt) from InfluenzaA__ALE31867__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaacgggaacauccgcugcaacaucugcaucuga

SEQ ID NO: 13623 - RNA, 1701 nt, Artificial Sequence; identical to SEQ ID NO: 68
  derived and/or modified CDS sequence (AUadapt) from InfluenzaA__ALE31868__HA

SEQ ID NO: 13624 - RNA, 1701 nt, Artificial Sequence; identical to SEQ ID NO: 13622
  derived and/or modified CDS sequence (AUadapt) from InfluenzaA__ALE31869__HA

SEQ ID NO: 13625 - RNA, 1701 nt, Artificial Sequence; identical to SEQ ID NO: 13622
  derived and/or modified CDS sequence (AUadapt) from InfluenzaA__ALE31870__HA

SEQ ID NO: 13626 - RNA, 1701 nt, Artificial Sequence
  derived and/or modified CDS sequence (AUadapt) from InfluenzaA__ALE31871__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcaacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13627 - RNA, 1701 nt, Artificial Sequence; identical to SEQ ID NO: 164
  derived and/or modified CDS sequence (AUadapt) from InfluenzaA__ALE31872__HA

SEQ ID NO: 13628 - RNA, 1701 nt, Artificial Sequence; identical to SEQ ID NO: 68
  derived and/or modified CDS sequence (AUadapt) from InfluenzaA__ALE31873__HA

SEQ ID NO: 13629 - RNA, 1701 nt, Artificial Sequence
  derived and/or modified CDS sequence (AUadapt) from InfluenzaA__ALE31874__HA
augaagaccaucaucgcccugucguacauccucugccugguguucgcccagaagcugcccggcaacgacaacuccgcggccacccucugccuggggcaccacgccgucccgaacggcacgaucgugaagaccaucaccaacgaccgcaucgaggugaccaacgccacggagcugguccagaacucguccaucggggagaucugcgacagcccccaccagauccucgacggcgagaacugcacccugaucgacgcccugcucggggacccccagugcgacggcuuccagaacaagaagugggaccuguucguggagcgguccaaggcgcacucgaacugcuaccccuacgacgugccggacuacgccucccugcgcagccucgucgccuccucgggcacccuggaguucaacaacgaguccuucaacugggccggggugacccagaacggcacgagcuccucgugcauccggggguccaacagcuccuucuucucgcgccugaacuggcucacccaccugaacuccaaguaccccgcgcugaacgugaccaugcccaacaacgagcaguucgacaagcucuacaucuggggcguccaccaccccgggaccgacaaggaccagaucuuccuguacgcccagagcucgggccggaucacgguguccaccaagcgcagccagcaggccgugaucccgaacaucggcucccggccccgcauccgggacauccccucgcgcaucuccaucuacuggaccaucgucaagcccggggacauccugcucaucaacagcaccggcaaccugaucgccccgcggggguacuucaagauccgcuccggcaagucguccaucaugcggagcgacgcccccaucggcaagugcaaguccgagugcaucacgcccaacgggucgauccccaacgacaagccguuccagaacgugaaccgcaucaccuacggcgcgugcccccgguacgugaagcaguccacccugaagcucgccaccgggaugcgcaacguccccgagaagcagacgcggggcaucuucggggccaucgccggcuucaucgagaacggcugggaggggaugguggacggcugguacggguuccgccaccagaacagcgagggccgggggcaggccgcggaccugaaguccacccaggccgccaucgaccagaucaacggcaagcugaaccgccucaucggcaagaccaacgagaaguuccaccagaucgagaaggaguucucggagguggaggggcggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagucgggcuacaaggacuggauccuguggaucagcuucgccaucuccugcuuccugcugugcguggcccugcucggguucaucaugugggcgugccagaagggcaacauccggugcaacaucugcaucuga

SEQ ID NO: 13630 - RNA, 1701 nt, Artificial Sequence; identical to SEQ ID NO: 13629
  derived and/or modified CDS sequence (AUadapt) from InfluenzaA__ALE31875__HA

SEQ ID NO: 13631 - RNA, 1701 nt, Artificial Sequence; identical to SEQ ID NO: 13629
  derived and/or modified CDS sequence (AUadapt) from InfluenzaA__ALE31876__HA

SEQ ID NO: 13632 - RNA, 1701 nt, Artificial Sequence
  derived and/or modified CDS sequence (AUadapt) from InfluenzaA__ALE31877__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccggaacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacucggagaucaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13633 - RNA, 1701 nt, Artificial Sequence; identical to SEQ ID NO: 68
  derived and/or modified CDS sequence (AUadapt) from InfluenzaA__ALE31878__HA

SEQ ID NO: 13634 - RNA, 1701 nt, Artificial Sequence; identical to SEQ ID NO: 68
  derived and/or modified CDS sequence (AUadapt) from InfluenzaA__ALE31879__HA

SEQ ID NO: 13635 - RNA, 1701 nt, Artificial Sequence; identical to SEQ ID NO: 68
  derived and/or modified CDS sequence (AUadapt) from InfluenzaA__ALE31880__HA

SEQ ID NO: 13636 - RNA, 1701 nt, Artificial Sequence
  derived and/or modified CDS sequence (AUadapt) from InfluenzaA__ALE31881__HA
augaagaccaucaucgcccugucgcacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucguggccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgucaagcacucgacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacgucuaccgcgacgaggcccugaacaaccgguuccagaucaaggggaucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13637 - RNA, 1701 nt, Artificial Sequence; identical to SEQ ID NO: 68
  derived and/or modified CDS sequence (AUadapt) from InfluenzaA__ALE31882__HA

SEQ ID NO: 13638 - RNA, 1701 nt, Artificial Sequence; identical to SEQ ID NO: 68
  derived and/or modified CDS sequence (AUadapt) from InfluenzaA__ALE31888__HA

SEQ ID NO: 13639 - RNA, 1701 nt, Artificial Sequence; identical to SEQ ID NO: 68
  derived and/or modified CDS sequence (AUadapt) from InfluenzaA__ALE31889__HA

SEQ ID NO: 13640 - RNA, 1701 nt, Artificial Sequence; identical to SEQ ID NO: 13344
  derived and/or modified CDS sequence (AUadapt) from InfluenzaA__ALE31890__HA

SEQ ID NO: 13641 - RNA, 1701 nt, Artificial Sequence; identical to SEQ ID NO: 13344
  derived and/or modified CDS sequence (AUadapt) from InfluenzaA__ALE31891__HA

SEQ ID NO: 13642 - RNA, 1701 nt, Artificial Sequence; identical to SEQ ID NO: 68
  derived and/or modified CDS sequence (AUadapt) from InfluenzaA__ALE31892__HA

SEQ ID NO: 13643 - RNA, 1701 nt, Artificial Sequence; identical to SEQ ID NO: 68
  derived and/or modified CDS sequence (AUadapt) from InfluenzaA__ALE31893__HA

SEQ ID NO: 13644 - RNA, 1701 nt, Artificial Sequence; identical to SEQ ID NO: 13292
  derived and/or modified CDS sequence (AUadapt) from InfluenzaA__ALE31894__HA

SEQ ID NO: 13645 - RNA, 1701 nt, Artificial Sequence; identical to SEQ ID NO: 164
  derived and/or modified CDS sequence (AUadapt) from InfluenzaA__ALE31895__HA

SEQ ID NO: 13646 - RNA, 1701 nt, Artificial Sequence; identical to SEQ ID NO: 68
  derived and/or modified CDS sequence (AUadapt) from InfluenzaA__ALE31896__HA

SEQ ID NO: 13647 - RNA, 1701 nt, Artificial Sequence; identical to SEQ ID NO: 68
  derived and/or modified CDS sequence (AUadapt) from InfluenzaA__ALE31897__HA

SEQ ID NO: 13648 - RNA, 1701 nt, Artificial Sequence; identical to SEQ ID NO: 68
  derived and/or modified CDS sequence (AUadapt) from InfluenzaA__ALE31898__HA

SEQ ID NO: 13649 - RNA, 1701 nt, Artificial Sequence
  derived and/or modified CDS sequence (AUadapt) from InfluenzaA__ALE31899__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaugaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13650 - RNA, 1701 nt, Artificial Sequence; identical to SEQ ID NO: 13292
  derived and/or modified CDS sequence (AUadapt) from InfluenzaA__ALE31901__HA

SEQ ID NO: 13651 - RNA, 1701 nt, Artificial Sequence
  derived and/or modified CDS sequence (AUadapt) from InfluenzaA__ALE31902__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13652 - RNA, 1701 nt, Artificial Sequence; identical to SEQ ID NO: 68
  derived and/or modified CDS sequence (AUadapt) from InfluenzaA__ALE31903__HA

SEQ ID NO: 13653 - RNA, 1701 nt, Artificial Sequence; identical to SEQ ID NO: 68
  derived and/or modified CDS sequence (AUadapt) from InfluenzaA__ALE31904__HA

SEQ ID NO: 13654 - RNA, 1701 nt, Artificial Sequence
  derived and/or modified CDS sequence (AUadapt) from InfluenzaA__ALE31905__HA
augaagaccaucaucgcccugggcuacauccucugccugggguucgcccagaagauccccggcaacgacaacucgaccgcgacgcugugccucgggcaccacgccgugccgaacggcaccaucgucaagaccaucaccaacgaccgcaucgaggugacgaacgccaccgagcuggugcagaacuccucgaucggggagaucugcgacagcccccacaagauccuggacggcgagaacugcacccucaucgacgcccugcugggcgacccccagugcgacggguuccagaacaagaagugggaccucuucgucgagcgguccaaggccuacuccaacugcuaccccuacgacgugccggacuacgcgucgcugcgcucccugguggccagcuccggcacccucgaguucaacaacgagucguucaacuggacgggggucacccagaacggcaccuccagcgccugcauccggcgcuccucguccagcuucuucucccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcagucguccggccgcaucaccgucagcacgaagcggucgcagcaggccgugaucccgaacaucgggucccgcccccggauccgcgacauccccucgcggaucuccaucuacuggaccaucgugaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgucaaccggaucacguacggggccugcccccgcuacgugaagcacuccacccugaagcuggcgaccggcaugcggaacgugcccgagaagcagacccgcgggaucuucggcgccaucgccggcuucaucgagaacgggugggagggcauggucgacgggugguacggcuuccggcaccagaacagcgaggggcgcggccaggccgccgaccucaaguccacgcaggcggccaucgaccagaucaacggcaagcugaaccggcugaucgggaagaccaacgagaaguuccaccagaucgagaaggaguucucggagguggagggccgcauccaggaccucgagaaguacguggaggacaccaagaucgaccugugguccuacaacgccgagcugcucgucgcccuggagaaccagcacaccaucgaccugacggacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggcguggagcucaagucgggguacaaggacuggauccuguggaucuccuucgccaucagcugcuuccugcucugcgucgcccugcugggcuucaucaugugggccugccagaaggggaacauccgcugcaacaucugcaucuga

SEQ ID NO: 13655 - RNA, 1701 nt, Artificial Sequence; identical to SEQ ID NO: 68
  derived and/or modified CDS sequence (AUadapt) from InfluenzaA__ALE31906__HA

SEQ ID NO: 13656 - RNA, 1701 nt, Artificial Sequence
  derived and/or modified CDS sequence (AUadapt) from InfluenzaA__ALE31907__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugucgaccaagcggucccagcaggccgugaucccgaacaucggcagccgcccccggauccgcgacauccccucccggaucucgaucuacuggacgaucgucaaguccggcgacauccugcugaucaacagcaccgggaaccucaucgcgccccgcggcuacuucaagauccgguccggcaagagcuccaucaugcgcucggacgccccgaucgggaagugcaaguccgagugcaucacccccaacggcagcauccccaacgacaagcccuuccagaacgugaaccggaucaccuacggggccugcccgcgcuacgugaagcacuccacgcugaagcuggccaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13657 - RNA, 1701 nt, Artificial Sequence; identical to SEQ ID NO: 68
  derived and/or modified CDS sequence (AUadapt) from InfluenzaA__ALE31908__HA

SEQ ID NO: 13658 - RNA, 1701 nt, Artificial Sequence
  derived and/or modified CDS sequence (AUadapt) from InfluenzaA__ALE31909__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaaguccggcgacauccugcugaucaacagcaccgggaaccucaucgcgccccgcggcuacuucaagauccgguccggcaagagcuccaucaugcgcucggacgccccgaucgggaagugcaaguccgagugcaucacccccaacggcagcauccccaacgacaagcccuuccagaacgugaaccggaucacguacggggccugcccgcgcuacgugaagcacuccacccugaagcuggccaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13659 - RNA, 1701 nt, Artificial Sequence; identical to SEQ ID NO: 68
  derived and/or modified CDS sequence (AUadapt) from InfluenzaA__ALE31910__HA

SEQ ID NO: 13660 - RNA, 1701 nt, Artificial Sequence; identical to SEQ ID NO: 13609
  derived and/or modified CDS sequence (AUadapt) from InfluenzaA__ALE31912__HA

SEQ ID NO: 13661 - RNA, 1701 nt, Artificial Sequence
  derived and/or modified CDS sequence (AUadapt) from InfluenzaA__ALE31913__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucgaguccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13662 - RNA, 1701 nt, Artificial Sequence; identical to SEQ ID NO: 68
  derived and/or modified CDS sequence (AUadapt) from InfluenzaA__ALE31914__HA

SEQ ID NO: 13663 - RNA, 1701 nt, Artificial Sequence
  derived and/or modified CDS sequence (AUadapt) from InfluenzaA__ALE31915__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggaguacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13664 - RNA, 1701 nt, Artificial Sequence; identical to SEQ ID NO: 68
  derived and/or modified CDS sequence (AUadapt) from InfluenzaA__ALE31916__HA

SEQ ID NO: 13665 - RNA, 1701 nt, Artificial Sequence; identical to SEQ ID NO: 68
  derived and/or modified CDS sequence (AUadapt) from InfluenzaA__ALE31917__HA

SEQ ID NO: 13666 - RNA, 1701 nt, Artificial Sequence; identical to SEQ ID NO: 13219
  derived and/or modified CDS sequence (AUadapt) from InfluenzaA__ALE31918__HA

SEQ ID NO: 13667 - RNA, 1701 nt, Artificial Sequence; identical to SEQ ID NO: 13344
  derived and/or modified CDS sequence (AUadapt) from InfluenzaA__ALE31920__HA

SEQ ID NO: 13668 - RNA, 1701 nt, Artificial Sequence; identical to SEQ ID NO: 68
  derived and/or modified CDS sequence (AUadapt) from InfluenzaA__ALE31921__HA

SEQ ID NO: 13669 - RNA, 1701 nt, Artificial Sequence; identical to SEQ ID NO: 68
  derived and/or modified CDS sequence (AUadapt) from InfluenzaA__ALE31922__HA

SEQ ID NO: 13670 - RNA, 1701 nt, Artificial Sequence; identical to SEQ ID NO: 13230
  derived and/or modified CDS sequence (AUadapt) from InfluenzaA__ALE31923__HA

SEQ ID NO: 13671 - RNA, 1701 nt, Artificial Sequence; identical to SEQ ID NO: 68
  derived and/or modified CDS sequence (AUadapt) from InfluenzaA__ALE31924__HA

SEQ ID NO: 13672 - RNA, 1701 nt, Artificial Sequence; identical to SEQ ID NO: 68
  derived and/or modified CDS sequence (AUadapt) from InfluenzaA__ALE31925__HA

SEQ ID NO: 13673 - RNA, 1701 nt, Artificial Sequence
  derived and/or modified CDS sequence (AUadapt) from InfluenzaA__ALE31926__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgagggguucaacuggacgggcgugacccagaacgggaccuccucggccugcauccggcgcuccagcuccucguucuucucccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcagagcuccggccgcaucaccgugucgaccaagcggagccagcaggccgugaucccgaacaucggcucccgcccccggauccgcgacauccccucgcggaucuccaucuacuggacgaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucaccuacggcgccugcccccgcuacgugaagcacuccacgcugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacccaggcggccaucgaccagaucaacggcaagcugaaccggcugaucggcaagacgaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugaccgacagcgagaugaacaagcuguucgagaagacgaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13674 - RNA, 1701 nt, Artificial Sequence; identical to SEQ ID NO: 68
  derived and/or modified CDS sequence (AUadapt) from InfluenzaA__ALE31927__HA

SEQ ID NO: 13675 - RNA, 1701 nt, Artificial Sequence
  derived and/or modified CDS sequence (AUadapt) from InfluenzaA__ALE31928__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcgagaacugcacccugaucgacgcccugcucggggacccccagugcgacggcuuccagaacaagaagugggaccuguucguggagcgguccaaggccuacagcaacugcuaccccuacgacgugccggacuacgcgucccugcgcucgcucgucgccuccagcggcacccuggaguucaacaacgaguccuucaacugggccggggugacgcagaacggcaccucguccgccugcauccgggggagcaacuccucguucuucucccgccugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccaguccucgggccggaucaccgugagcaccaagcgcucccagcaggccgugaucccgaacaucggcucgcggccccgcauccgggacauccccucccgcaucagcaucuacuggaccaucgucaagcccggggacauccugcugaucaacuccacgggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcagagcacccugaagcuggccacggggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagucgacccaggccgccaucgaccagaucaacggcaagcugaaccgccugaucggcaagaccaacgagaaguuccaccagaucgagaaggaguucuccgagguggaggggcggauccaggaccucgagaaguacgucgaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggacguacgaccacgacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 13676 - RNA, 1701 nt, Artificial Sequence; identical to SEQ ID NO: 13322
  derived and/or modified CDS sequence (AUadapt) from InfluenzaA__ALE31930__HA

SEQ ID NO: 13677 - RNA, 1701 nt, Artificial Sequence; identical to SEQ ID NO: 68
  derived and/or modified CDS sequence (AUadapt) from InfluenzaA__ALE31931__HA

SEQ ID NO: 13678 - RNA, 1701 nt, Artificial Sequence; identical to SEQ ID NO: 68
  derived and/or modified CDS sequence (AUadapt) from InfluenzaA__ALE31932__HA

SEQ ID NO: 13679 - RNA, 1701 nt, Artificial Sequence
  derived and/or modified CDS sequence (AUadapt) from InfluenzaA__ALE31933__HA
augaagaccaucaucgcccugucguacauccucugccugguguacgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13680 - RNA, 1701 nt, Artificial Sequence
  derived and/or modified CDS sequence (AUadapt) from InfluenzaA__ALE31934__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccaggcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugauccccaacaucggcucgcgcccgcggauccgcgacauccccucccggaucagcaucuacuggaccaucgucaagcccggcgacauccugcugaucaacuccaccgggaaccucaucgcgccccgcggcuacuucaagauccggucggggaaguccagcaucaugcgcuccgacgccccgaucggcaagugcaagucggagugcaucacccccaacggcuccauccccaacgacaagcccuuccagaacgugaaccggaucacguacggggccugcccgcgcuacgugaagcacagcacccugaagcuggccaccggcaugcggaacauccccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13681 - RNA, 1701 nt, Artificial Sequence; identical to SEQ ID NO: 68
  derived and/or modified CDS sequence (AUadapt) from InfluenzaA__ALE31935__HA

SEQ ID NO: 13682 - RNA, 1701 nt, Artificial Sequence; identical to SEQ ID NO: 13468
  derived and/or modified CDS sequence (AUadapt) from InfluenzaA__ALE31936__HA

SEQ ID NO: 13683 - RNA, 1701 nt, Artificial Sequence
  derived and/or modified CDS sequence (AUadapt) from InfluenzaA__ALE31937__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccaacgaccgcaucgaggugacgaacgccaccgagcugguccagaacucguccaucggcgagaucugcgacagcccccaccagauccucgacggggagaacugcacccugaucgacgcccugcucggcgacccccagugcgacggguuccagaacaagaagugggaccuguucguggagcgguccaaggccuacucgaacugcuaccccuacgacgugccggacuacgcgucccugcgcagccucgucgccuccucgggcacccuggaguucaacaacgaguccuucaacugggccggcgugacgcagaacgggaccagcuccucgugcauccggggcuccaacagcuccuucuucucgcgccugaacuggcucacccaccugaacuccaaguaccccgcccugaacgugaccaugcccaacaacgagcaguucgacaagcucuacaucuggggcguccaccaccccgggacggacaaggaccagaucuuccuguacgcgcagccgagcgggcggaucaccgugucgaccaagcgcucccagcaggccgugauccccaacaucggcagccggccccgcauccgggacauccccucccgcaucucgaucuacuggaccaucgucaagccgggcgacauccugcucaucaacuccacggggaaccugaucgcgccccggggcuacuucaagauccgcagcgggaaguccucgaucaugcgguccgacgcccccaucggcaagugcaagagcgagugcaucacccccaacggcuccaucccgaacgacaagcccuuccagaacgugaaccgcaucaccuacggggccugcccccgguacgugaagcagucgacccugaagcucgccacgggcaugcgcaacguccccgagcggcagacccgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccuggagaaguacgucgaggacacgaagaucgaccuguggucguacaacgccgagcuccugguggcccuggagaaccagcacaccaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcacguacgaccacgacguguaccgcgacgaggcccucaacaaccgguuccagaucaagggggucgagcugaaguccggcuacaaggacuggauccuguggaucucguucgccaucagcugcuuccuccugugcguggcccugcucggcuucaucaugugggccugccagaaggggaacauccgcugcaacaucugcaucuga

SEQ ID NO: 13684 - RNA, 1701 nt, Artificial Sequence; identical to SEQ ID NO: 68
  derived and/or modified CDS sequence (AUadapt) from InfluenzaA__ALE31938__HA

SEQ ID NO: 13685 - RNA, 1701 nt, Artificial Sequence; identical to SEQ ID NO: 13292
  derived and/or modified CDS sequence (AUadapt) from InfluenzaA__ALE31939__HA

SEQ ID NO: 13686 - RNA, 1701 nt, Artificial Sequence; identical to SEQ ID NO: 68
  derived and/or modified CDS sequence (AUadapt) from InfluenzaA__ALE31941__HA

SEQ ID NO: 13687 - RNA, 1701 nt, Artificial Sequence; identical to SEQ ID NO: 13243
  derived and/or modified CDS sequence (AUadapt) from InfluenzaA__ALE31943__HA

SEQ ID NO: 13688 - RNA, 1701 nt, Artificial Sequence
  derived and/or modified CDS sequence (AUadapt) from InfluenzaA__ALE31944__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccucggccugcauccggggcuccaacagcuccuucuucucgcgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagagcucggggcggaucaccguguccaccaagcgcagccagcaggccgugaucccgaacaucggcucccggccccgcauccgggacauccccucgcgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgaccugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagagcggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13689 - RNA, 1701 nt, Artificial Sequence
  derived and/or modified CDS sequence (AUadapt) from InfluenzaA__ALE31945__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagggcucccagcaggccgugaucccgaacgucggcucgcggccccgcauccgggacauccccucccgcaucagcaucuacuggaccaucgugaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucacguacggcgccugcccccgguacgucaagcacagcacccugaagcuggcgaccgggaugcgcaacgugcccgagaagcagacccggggcaucuucggggccaucgccggcuucaucgagaacggcugggaggggaugguggacggcugguacggguuccgccaccagaacuccgagggccgggggcaggccgccgaccucaagucgacgcaggcggccaucgaccagaucaacggcaagcugaaccgccugaucggcaagaccaacgagaaguuccaccagaucgagaaggaguucuccgaggucgaggggcggauccaggacaucgagaaguacguggaggacaccaagaucgaccucuggagcuacaacgccgagcugcugguggcccucgagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccgcaacgggaccuacgaccacaacgucuaccgggacgaggcccugaacaaccgcuuccagaucaagggcguggagcugaaguccggcuacaaggacuggauccucuggaucagcuucgccaucagcugcuuccugcugugcguggcccuccugggguucaucaugugggccugccagaagggcaacauccggugcaacaucugcaucuga

SEQ ID NO: 13690 - RNA, 1701 nt, Artificial Sequence; identical to SEQ ID NO: 13344
  derived and/or modified CDS sequence (AUadapt) from InfluenzaA__ALE31946__HA

SEQ ID NO: 13691 - RNA, 1701 nt, Artificial Sequence; identical to SEQ ID NO: 13344
  derived and/or modified CDS sequence (AUadapt) from InfluenzaA__ALE31947__HA

SEQ ID NO: 13692 - RNA, 1701 nt, Artificial Sequence
  derived and/or modified CDS sequence (AUadapt) from InfluenzaA__ALE31948__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcuggugggcaagaccaacgagaaguuccaccagaucgagaaggaguucuccgaggucgagggccgcauccaggaccucgagaaguacguggaggacaccaagaucgaccuguggagcuacaacgccgaguuccugguggcccucgagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcugaaguccggcuacaaggacuggauccucuggaucagcuucgccaucagcugcuuccugcugugcguggcccuccugggcuucaucaugugggccugccagaaggggaacauccgcugcaacaucugcaucuga

SEQ ID NO: 13693 - RNA, 1701 nt, Artificial Sequence; identical to SEQ ID NO: 13344
  derived and/or modified CDS sequence (AUadapt) from InfluenzaA__ALE31949__HA

SEQ ID NO: 13694 - RNA, 1701 nt, Artificial Sequence; identical to SEQ ID NO: 68
  derived and/or modified CDS sequence (AUadapt) from InfluenzaA__ALE31950__HA

SEQ ID NO: 13695 - RNA, 1701 nt, Artificial Sequence; identical to SEQ ID NO: 13230
  derived and/or modified CDS sequence (AUadapt) from InfluenzaA__ALE31951__HA

SEQ ID NO: 13696 - RNA, 1701 nt, Artificial Sequence; identical to SEQ ID NO: 68
  derived and/or modified CDS sequence (AUadapt) from InfluenzaA__ALE31952__HA

SEQ ID NO: 13697 - RNA, 1701 nt, Artificial Sequence
  derived and/or modified CDS sequence (AUadapt) from InfluenzaA__ALE31953__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuucgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13698 - RNA, 1701 nt, Artificial Sequence
  derived and/or modified CDS sequence (AUadapt) from InfluenzaA__ALE31954__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggucgcucgucgccuccagcggcacccuggaguucaacgacgaguccuucaacugggccggggugacgcagaacggcaccucguccgccugcauccgcgggagcaacuccucguucuucucccggcugaacuggcucacccacagcaacuucaaguaccccgcgcugaacgugaccaugcccaacaacgagcaguucgacaagcuguacaucuggggcguccaccaccccgggacggacaaggaccagaucuuccucuacgcccacuccucgggccgcaucaccgugagcaccaagcggucccagcaggccgugaucccgaacgucggcucgcgcccccggauccgcaacauccccucccggaucagcaucuacuggaccaucgugaagcccggggacauccugcugaucaacuccacgggcaaccucaucgccccgcgcggguacuucaagauccagucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgucaagcagagcacccugaagcuggccacggggaugcgcaacgugcccgagaagcagacccggggcaucuucggggccaucgccggcuucaucgagaacggcugggaggggaugaaggacggcugguacggguuccgccaccagaacuccgagggccgggggcaggccgcggaccucaagucgacccaggccgccaucgaccagaucaacggcaagcugaaccgccuggugggcaagaccaacgagaaguuccaccagaucgagaaggaguucuccgaggucgaggggcggauccaggaccucgagaaguacguggaggacacgaagaucgaccuguggagcuacaacgccgagcugcucguggcccuggagaaccagcacaccaucgaccugaccgacuccgagaugaacaagcuguucgagaagaccaagaagcagcuccgcgagaacgcggaggacaugggcaacgggugcuucaagaucuaccacaagugcgacaacgccugcaucggcucgauccgcaacgggacguacgaccacuacgucuaccgggacgaggcccugaacaaccgcuuccagaucaagggcguggagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 13699 - RNA, 1701 nt, Artificial Sequence; identical to SEQ ID NO: 68
  derived and/or modified CDS sequence (AUadapt) from InfluenzaA__ALE31955__HA

SEQ ID NO: 13700 - RNA, 1701 nt, Artificial Sequence
  derived and/or modified CDS sequence (AUadapt) from InfluenzaA__ALE31956__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcaacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13701 - RNA, 1701 nt, Artificial Sequence; identical to SEQ ID NO: 13292
  derived and/or modified CDS sequence (AUadapt) from InfluenzaA__ALE31957__HA

SEQ ID NO: 13702 - RNA, 1701 nt, Artificial Sequence
  derived and/or modified CDS sequence (AUadapt) from InfluenzaA__ALE31958__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgaagccccgcauccgggacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13703 - RNA, 1701 nt, Artificial Sequence
  derived and/or modified CDS sequence (AUadapt) from InfluenzaA__ALE31959__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccgguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgcggaccucaagucgacccaggccgccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggcgugccagaaggggaacauccgcugcaacaucugcaucuga

SEQ ID NO: 13704 - RNA, 1701 nt, Artificial Sequence; identical to SEQ ID NO: 68
  derived and/or modified CDS sequence (AUadapt) from InfluenzaA__ALE31960__HA

SEQ ID NO: 13705 - RNA, 1701 nt, Artificial Sequence; identical to SEQ ID NO: 12875
  derived and/or modified CDS sequence (AUadapt) from InfluenzaA__ALE31961__HA

SEQ ID NO: 13706 - RNA, 1701 nt, Artificial Sequence
  derived and/or modified CDS sequence (AUadapt) from InfluenzaA__ALE31962__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaugagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13707 - RNA, 1701 nt, Artificial Sequence
  derived and/or modified CDS sequence (AUadapt) from InfluenzaA__ALE31963__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaccuuccucuacgcgcaguccagcgggcgcaucacggugucgaccaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacgcccaacggcuccauccccaacgacaagccguuccagaacgugaaccggaucaccuacggggccugcccccgcuacgugaagcacucgacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagagcacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggucguacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacaaccacaacguguaccgcgacgaggcccugaacaaccgguuccagaucaagggggucgagcucaaguccggcuacaaggacuggauccuguggaucucguucgccaucagcugcuuccugcucugcguggcccugcugggcuucaucaugugggccugccagaaggggaacauccgcugcaacaucugcaucuga

SEQ ID NO: 13708 - RNA, 1701 nt, Artificial Sequence
  derived and/or modified CDS sequence (AUadapt) from InfluenzaA__ALE31964__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacuacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccagagcgggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13709 - RNA, 1701 nt, Artificial Sequence; identical to SEQ ID NO: 68
  derived and/or modified CDS sequence (AUadapt) from InfluenzaA__ALE31965__HA

SEQ ID NO: 13710 - RNA, 1701 nt, Artificial Sequence; identical to SEQ ID NO: 13344
  derived and/or modified CDS sequence (AUadapt) from InfluenzaA__ALE31966__HA

SEQ ID NO: 13711 - RNA, 1701 nt, Artificial Sequence; identical to SEQ ID NO: 13614
  derived and/or modified CDS sequence (AUadapt) from InfluenzaA__ALE31967__HA

SEQ ID NO: 13712 - RNA, 1701 nt, Artificial Sequence; identical to SEQ ID NO: 13230
  derived and/or modified CDS sequence (AUadapt) from InfluenzaA__ALE31968__HA

SEQ ID NO: 13713 - RNA, 1701 nt, Artificial Sequence; identical to SEQ ID NO: 13337
  derived and/or modified CDS sequence (AUadapt) from InfluenzaA__ALE31969__HA

SEQ ID NO: 13714 - RNA, 1701 nt, Artificial Sequence; identical to SEQ ID NO: 68
  derived and/or modified CDS sequence (AUadapt) from InfluenzaA__ALE31970__HA

SEQ ID NO: 13715 - RNA, 1701 nt, Artificial Sequence
  derived and/or modified CDS sequence (AUadapt) from InfluenzaA__ALE31971__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacgccuaccccgcgcugaacgugacgaugcccaacaacgagcaguucgacaagcuguacaucuggggcguccaccaccccgggaccgacaaggaccagaucuuccucuacgcccaguccucggggcgcaucaccgugagcaccaagggcucccagcaggccgugaucccgaacaucggcucgcggccccgcauccgggacauccccucccgcaucagcaucuacuggacgaucgucaagcccggggacauccugcugaucaacuccaccggcaaccucaucgccccgcggggguacuucaagauccgcucgggcaaguccagcaucaugcgguccgacgcccccaucggcaagugcaagucggagugcaucacccccaacggguccauccccaacgacaagccguuccagaacgugaaccgcaucaccuacggcgcgugcccccgguacgugaagcacagcacgcugaagcuggccaccgggaugcgcaacguccccgagaagcagacccggggcaucuucggggccaucgccggcuucaucgagaacggcugggaggggaugguggacggcugguacggguuccgccaccagaacuccgagggccgggggcaggccgcggaccucaagucgacccaggccgccaucgaccagaucaacggcaagcugaaccgccugaucggcaagacgaacgagaaguuccaccagaucgagaaggaguucuccgagguggaggggcggauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgcggaggacaugggcaacgggugcuucaagaucuaccacaagugcgacaacgccugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggcgugccagaagggcaacauccggugcaacaucugcaucuga

SEQ ID NO: 13716 - RNA, 1701 nt, Artificial Sequence; identical to SEQ ID NO: 13230
  derived and/or modified CDS sequence (AUadapt) from InfluenzaA__ALE31972__HA

SEQ ID NO: 13717 - RNA, 1701 nt, Artificial Sequence; identical to SEQ ID NO: 13230
  derived and/or modified CDS sequence (AUadapt) from InfluenzaA__ALE31973__HA

SEQ ID NO: 13718 - RNA, 1701 nt, Artificial Sequence; identical to SEQ ID NO: 12875
  derived and/or modified CDS sequence (AUadapt) from InfluenzaA__ALE31974__HA

SEQ ID NO: 13719 - RNA, 1701 nt, Artificial Sequence; identical to SEQ ID NO: 13230
  derived and/or modified CDS sequence (AUadapt) from InfluenzaA__ALE31975__HA

SEQ ID NO: 13720 - RNA, 1701 nt, Artificial Sequence; identical to SEQ ID NO: 68
  derived and/or modified CDS sequence (AUadapt) from InfluenzaA__ALE31976__HA

SEQ ID NO: 13721 - RNA, 1701 nt, Artificial Sequence; identical to SEQ ID NO: 68
  derived and/or modified CDS sequence (AUadapt) from InfluenzaA__ALE31977__HA

SEQ ID NO: 13722 - RNA, 1701 nt, Artificial Sequence
  derived and/or modified CDS sequence (AUadapt) from InfluenzaA__ALE31978__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugauccacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13723 - RNA, 1701 nt, Artificial Sequence; identical to SEQ ID NO: 68
  derived and/or modified CDS sequence (AUadapt) from InfluenzaA__ALE31979__HA

SEQ ID NO: 13724 - RNA, 1701 nt, Artificial Sequence
  derived and/or modified CDS sequence (AUadapt) from InfluenzaA__ALE31980__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccgaguacaaggacuggauccuguggaucagcuucgccaucagcugcuuccugcucugcguggcccugcugggcuucaucaugugggccugccagaagggcaacauccgcugcaacaucugcaucuga

SEQ ID NO: 13725 - RNA, 1701 nt, Artificial Sequence; identical to SEQ ID NO: 68
  derived and/or modified CDS sequence (AUadapt) from InfluenzaA__ALE31981__HA

SEQ ID NO: 13726 - RNA, 1701 nt, Artificial Sequence; identical to SEQ ID NO: 13226
  derived and/or modified CDS sequence (AUadapt) from InfluenzaA__ALE31995__HA

SEQ ID NO: 13727 - RNA, 1701 nt, Artificial Sequence
  derived and/or modified CDS sequence (AUadapt) from InfluenzaA__ALE31996__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccgggugacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13728 - RNA, 1701 nt, Artificial Sequence
  derived and/or modified CDS sequence (AUadapt) from InfluenzaA__ALE31997__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucaucgagcgguccaaggccuacagcaacugcuaccccuacgacgugccggacuacgcgucccugcgcucgcugguggccuccagcggcacccucgaguucaacaacgaguccuucaacuggacgggggucacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcgugcaccaccccgggaccgacaaggaccagaucuuccucuacgcgcaguccucggggcgcaucaccgucagcacgaagcggucccagcaggccgugaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgucaaccggaucacguacggggccugcccccgcuacgugaagcacagcacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13729 - RNA, 1701 nt, Artificial Sequence; identical to SEQ ID NO: 68
  derived and/or modified CDS sequence (AUadapt) from InfluenzaA__ALE31998__HA

SEQ ID NO: 13730 - RNA, 1701 nt, Artificial Sequence
  derived and/or modified CDS sequence (AUadapt) from InfluenzaA__ALE31999__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccuccacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13731 - RNA, 1701 nt, Artificial Sequence
  derived and/or modified CDS sequence (AUadapt) from InfluenzaA__ALE32000__HA
augaagaccaucaucgcccugucgcacauccucugccugguguucgcccagaagcugcccgagaacgacaacuccaccgcgacgcucugccugggccaccacgccgucccgaacgggaccaucgugaagaccaucaccucggaccgcaucgaggugacgaacgccaccgagcugguccagaacuccagcaucggcgagaucugcgacucgccccaccagauccucgacgggaagaacugcacccugaucgacgcccugcucggcgacccccagugcgacggguuccagaacaagaagugggaccuguucguggagcggagcaaggccuacuccaacugcuaccccuacgacgugccggacuacgcgucgcugcgcucccucgucgccagcuccggcacccuggaguucaacgacgagucguucaacugggccggcgugacgcagaacgggaccuccagcgccugcauccggggcuccaacucguccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagucgagcgggcggaucaccguguccaccaagcgcucgcagcaggccgugaucccgaacaucggcucccggccccgcauccggaacauccccagccgcaucuccaucuacuggaccaucgucaagcccggcgacauccugcugaucaacucgacggggaaccucaucgccccgcggggcuacuucaagauccgcuccgggaaguccuccaucaugcggagcgacgcccccaucggcaagugcaaguccgagugcaucacccccaacggcucgauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacagcgaggggcggggccaggccgcggaccucaaguccacccaggccgccaucgaccagaucaacgggaagcugaaccgccugaucggcaagaccaacgagaaguuccaccagaucgagaaggaguucucggagguggagggccggauccaggaccucgagaaguacguggaggacacgaagaucgaccugugguccuacaacgccgagcugcucgucgcccuggagaaccagcacaccaucgaccugaccgacagcgagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaaggggguggagcucaagucgggcuacaaggacuggauccuguggaucagcuucgccaucuccugcuuccugcucugcgucgcccugcugggcuucaucaugugggcgugccagaaggggaacauccggugcaacaucugcaucuga

SEQ ID NO: 13732 - RNA, 1701 nt, Artificial Sequence; identical to SEQ ID NO: 68
  derived and/or modified CDS sequence (AUadapt) from InfluenzaA__ALE32001__HA

SEQ ID NO: 13733 - RNA, 1701 nt, Artificial Sequence; identical to SEQ ID NO: 68
  derived and/or modified CDS sequence (AUadapt) from InfluenzaA__ALE32002__HA

SEQ ID NO: 13734 - RNA, 1701 nt, Artificial Sequence; identical to SEQ ID NO: 12786
  derived and/or modified CDS sequence (AUadapt) from InfluenzaA__ALE32003__HA

SEQ ID NO: 13735 - RNA, 1701 nt, Artificial Sequence; identical to SEQ ID NO: 68
  derived and/or modified CDS sequence (AUadapt) from InfluenzaA__ALE32004__HA

SEQ ID NO: 13736 - RNA, 1701 nt, Artificial Sequence; identical to SEQ ID NO: 68
  derived and/or modified CDS sequence (AUadapt) from InfluenzaA__ALE32005__HA

SEQ ID NO: 13737 - RNA, 1701 nt, Artificial Sequence; identical to SEQ ID NO: 13230
  derived and/or modified CDS sequence (AUadapt) from InfluenzaA__ALE32006__HA

SEQ ID NO: 13738 - RNA, 1701 nt, Artificial Sequence; identical to SEQ ID NO: 68
  derived and/or modified CDS sequence (AUadapt) from InfluenzaA__ALE32007__HA

SEQ ID NO: 13739 - RNA, 1701 nt, Artificial Sequence; identical to SEQ ID NO: 13237
  derived and/or modified CDS sequence (AUadapt) from InfluenzaA__ALE32008__HA

SEQ ID NO: 13740 - RNA, 1701 nt, Artificial Sequence
  derived and/or modified CDS sequence (AUadapt) from InfluenzaA__ALE32009__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcggucgaaggccuacuccaacugcuaccccuacgacgugccggacuacgcgagccugcgcucccucgucgccucguccggcacccuggaguucaacgacgagagcuucaacugggccggcgugacgcagaacgggaccuccagcgccugcauccggggcuccaacucguccuucuucagccgccugaacuggcucacccacuccaacuucaaguaccccgcgcugaacgugaccaugcccaacaacgagcaguucgacaagcuguacaucuggggcguccaccaccccgggacggacaaggaccagaucuuccucuacgcccagucgagcgggcggaucaccguguccaccaagcgcucgcagcaggccgugaucccgaacaucggcucccggccccgcauccggaacauccccagccgcaucuccaucuacuggaccaucgucaagcccggcgacauccugcugaucaacagcacggggaaccucaucgccccgcggggcuacuucaagauccgcuccgggaaguccuccaucaugcggucggacgcccccaucggcaagugcaaguccgagugcaucacccccaacggcagcauccccaacgacaagccguuccagaacgugaaccgcaucaccuacggggcgugcccccgguacgugaagcaguccacccugaagcuggccacgggcaugcgcaacguccccgagaagcagacccgggggaucuucggcgccaucgccggguucaucgagaacggcugggagggcaugaaggacgggugguacggcuuccgccaccagaacucggaggggcggggccaggccgcggaccucaaguccacccaggccgccaucgaccagaucaacgggaagcugaaccgccugaucggcaagaccaacgagaaguuccaccagaucgagaaggaguucagcgagguggagggccggauccaggaccucgagaaguacguggaggacacgaagaucgaccugugguccuacaacgccgagcugcucgucgcccuggagaaccagcacaccaucgugcugaccgacucggagaugaacaagcuguucgagaagaccaagaagcagcuccgcgagaacgcggaggacauggggaacggcugcuucaagaucuaccacaagugcgacaacgccugcaucggguccauccgcaacggcacguacgaccacgacguguaccgggacgaggcccugaacaaccgcuuccagaucaagggggucgagcucaagagcggcuacaaggacuggauccuguggaucagcuucgccaucuccugcuuccugcucugcguggcccugcugggcuucaucaugugggcgugccaggaggggaacauccggugcaacaucugcaucuga

SEQ ID NO: 13741 - RNA, 1701 nt, Artificial Sequence
  derived and/or modified CDS sequence (AUadapt) from InfluenzaA__ALE32010__HA
augaagaccaucaucgcccugucguacauccucugccuggccuucgcgcagaagauccccggcaacgacaacuccaccgccacgcugugccucgggcaccacgccgugccgaacggcaccaucgucaagaccaucaccaacgaccgcaucgaggugacgaacgccaccgagcuggugcagaacucguccaucggggagaucugcgacagcccccaccagauccuggacggcgagaacugcacccucaucgacgcccugcugggggacccccagugcgacggcuuccagaacaagaagugggaccucuucgucgagcgguccaaggcguacucgaacugcuaccccuacgacgugccggacuacgccucccugcgcagccugguggccuccucgggcacccucgaguucaacaacgaguccuucaacuggacgggggucacccagaacggcaccagcuccgccugcauccggcgcucguccagcuccuucuucucgcggcugaacuggcugacccaccuccacuacacguaccccgcgcugaacgugaccaugcccaacaacgagcaguucgacaagcuguacaucuggggcgugcaccaccccgggaccgacaaggaccagaucuuccucuacgcccaguccagcgggcgcaucaccgucucgacgaagcggucccagcaggccgugaucccgaacaucggcagccgcccccggauccgcgacauccccucccggaucucgaucuacuggaccaucgugaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgucaaccggaucacguacggggcgugcccccgcuacgugaagcacucgacccugaagcuggccaccggcaugcggaacgugcccgagaagcagacccgcgggaucuucggcgccaucgccggguucaucgagaacggcugggagggcauggucgacgggugguacggcuuccggcaccagaacuccgaggggcgcggccaggccgcggaccucaagagcacgcaggccgccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggucguacaacgccgagcugcucgucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacaacguguaccgcgacgaggcccugaacaaccgguuccagaucaaggggguggagcucaaguccggcuacaaggacuggauccuguggaucucguucgccaucagcugcuuccugcucugcgucgcccugcugggcuucaucaugugggcgugccagaaggggaacauccgcugcaacaucugcaucuga

SEQ ID NO: 13742 - RNA, 1701 nt, Artificial Sequence; identical to SEQ ID NO: 13700
  derived and/or modified CDS sequence (AUadapt) from InfluenzaA__ALE32011__HA

SEQ ID NO: 13743 - RNA, 1701 nt, Artificial Sequence; identical to SEQ ID NO: 13243
  derived and/or modified CDS sequence (AUadapt) from InfluenzaA__ALE32012__HA

SEQ ID NO: 13744 - RNA, 1701 nt, Artificial Sequence; identical to SEQ ID NO: 68
  derived and/or modified CDS sequence (AUadapt) from InfluenzaA__ALE32013__HA

SEQ ID NO: 13745 - RNA, 1701 nt, Artificial Sequence
  derived and/or modified CDS sequence (AUadapt) from InfluenzaA__ALE32014__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccagcucaacuacacguaccccgcccugaacgugaccaugcccaacaacgagcaguucgacaagcuguacaucuggggcguccaccaccccgggaccgacaaggaccagaucuuccucuacgcgcaguccucggggcggaucaccgugagcacgaagcgcucccagcaggccgugaucccgaacaucggcucgcggccccgcauccgggacauccccucccgcaucagcaucuacuggaccaucgucaagcccggcgacauccugcugaucaacuccaccgggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccgcaacggcaccuacgaccacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13746 - RNA, 1701 nt, Artificial Sequence; identical to SEQ ID NO: 13571
  derived and/or modified CDS sequence (AUadapt) from InfluenzaA__ALE32015__HA

SEQ ID NO: 13747 - RNA, 1701 nt, Artificial Sequence; identical to SEQ ID NO: 68
  derived and/or modified CDS sequence (AUadapt) from InfluenzaA__ALE32016__HA

SEQ ID NO: 13748 - RNA, 1701 nt, Artificial Sequence; identical to SEQ ID NO: 68
  derived and/or modified CDS sequence (AUadapt) from InfluenzaA__ALE32017__HA

SEQ ID NO: 13749 - RNA, 1701 nt, Artificial Sequence; identical to SEQ ID NO: 68
  derived and/or modified CDS sequence (AUadapt) from InfluenzaA__ALE32018__HA

SEQ ID NO: 13750 - RNA, 1701 nt, Artificial Sequence; identical to SEQ ID NO: 13230
  derived and/or modified CDS sequence (AUadapt) from InfluenzaA__ALE32020__HA

SEQ ID NO: 13751 - RNA, 1701 nt, Artificial Sequence; identical to SEQ ID NO: 13337
  derived and/or modified CDS sequence (AUadapt) from InfluenzaA__ALE32021__HA

SEQ ID NO: 13752 - RNA, 1701 nt, Artificial Sequence; identical to SEQ ID NO: 13417
  derived and/or modified CDS sequence (AUadapt) from InfluenzaA__ALE32022__HA

SEQ ID NO: 13753 - RNA, 1701 nt, Artificial Sequence; identical to SEQ ID NO: 68
  derived and/or modified CDS sequence (AUadapt) from InfluenzaA__ALE32023__HA

SEQ ID NO: 13754 - RNA, 1701 nt, Artificial Sequence
  derived and/or modified CDS sequence (AUadapt) from InfluenzaA__ALE32024__HA
augaagaccaucaucgcccugucguacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagaacagcuccaucggggagaucugcgacucgccccaccagauccucgacggcaagaacugcacccugaucgacgcccugcucggggacccccagugcgacggcuuccagaacaagcggugggaccuguucguggagcgcuccaaggccuacagcaacugcuaccccuacgacgugccggacuacgcgucccugcggucgcucgucgccuccagcggcacccuggaguucaacgacgaguccuucaacugggccggggugacgcagaacggcaagucguccgccugcauccgcgggagcaacuccucguucuucucccggcugaacuggcucacccacagcaacuucaaguaccccgcgcugaacgugaccaugcccaacaacgagcaguucgacaagcuguacaucuggggcguccaccaccccgggaccgacaaggaccagaucuuccucuacgcccacuccucgggccgcaucacggugagcaccaagcggucccagcaggccgugaucccgaacaucggcucgcgcccccggauccgcaacauccccucccggaucagcaucuacuggaccaucgucaagcccggggacauccugcugaucaacuccaccggcaaccucaucgccccgcgcggguacuucaagauccagucgggcaaguccagcaucaugcgguccgacgcccccaucggcaagugcaagucggagugcaucacgcccaacggguccauccccaacgacaagccguuccagaacgugaaccgcaucaccuacgggaccugcccccgguacgugaagcagagcacccugaagcuggcgacgggcaugcgcaacguccccgagaagcagacccggggcaucuucggggccaucgccggcuucaucgagaacggcugggaggggaugaaggacggcugguacggguuccgccaccagaacuccgagggccgggggcaggccgccgaccucaagucgacccaggcggccaucgaccagaucaacggcaagcugaaccgccugaucggcaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgccgaggacaugggcaacgggugcuucaagaucuaccacaagugcgacaacgcgugcaucggcucgauccgcaacgggacguacgaccacuacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 13755 - RNA, 1701 nt, Artificial Sequence
  derived and/or modified CDS sequence (AUadapt) from InfluenzaA__ALE32025__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccagcuccgccugcauccgcaagucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugagcacgaagcggucccagcaggccgugaucccgaacaucggcucgcgcccccggauccgcgacauccccucccggaucagcaucuacuggaccaucgucaaguccggcgacauccugcugaucaacucgaccgggaaccucaucgcgccccgcggcuacuucaagauccgguccggcaagagcuccaucaugcgcucggacgccccgaucgggaagugcaaguccgagugcaucacccccaacggcagcauccccaacgacaagcccuuccagaacgugaaccggaucacguacggggccugcccgcgcuacgugaagcacuccacccugaagcuggccaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagauguccaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13756 - RNA, 1701 nt, Artificial Sequence; identical to SEQ ID NO: 68
  derived and/or modified CDS sequence (AUadapt) from InfluenzaA__ALE32026__HA

SEQ ID NO: 13757 - RNA, 1701 nt, Artificial Sequence; identical to SEQ ID NO: 13230
  derived and/or modified CDS sequence (AUadapt) from InfluenzaA__ALE32027__HA

SEQ ID NO: 13758 - RNA, 1701 nt, Artificial Sequence
  derived and/or modified CDS sequence (AUadapt) from InfluenzaA__ALE32028__HA
augaagaccaucaucgcccugucgcacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccucgaucaugcgcuccgacgcccccaucggcaagugcaagagcgagugcaucacccccaacggcuccauccccaacgacaagccguuccagaacgugaaccggaucacguacggggccugcccccgcuacgugaagcacucgacccugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagagcacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggucguacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacaacguguaccgcgacgaggcccugaacaaccgguuccagaucaaggggguggagcucaaguccggcuacaaggacuggauccuguggaucucguucgccaucagcugcuuccugcucugcgucgcccugcugggcuucaucaugugggccugccagaaggggaacauccgcugcaacaucugcaucuga

SEQ ID NO: 13759 - RNA, 1701 nt, Artificial Sequence; identical to SEQ ID NO: 13337
  derived and/or modified CDS sequence (AUadapt) from InfluenzaA__ALE32029__HA

SEQ ID NO: 13760 - RNA, 1701 nt, Artificial Sequence
  derived and/or modified CDS sequence (AUadapt) from InfluenzaA__ALE32030__HA
augaagaccaucaucgcccugucgcacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaucuaccccgcccugaacgugacgaugcccaacaacgagcaguucgacaagcuguacaucuggggcguccaccaccccgggaccgacaaggaccagaucuuccucuacgcgcaguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13761 - RNA, 1701 nt, Artificial Sequence
  derived and/or modified CDS sequence (AUadapt) from InfluenzaA__ALE32031__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggccugccagaaggggaacauccgcugcaacaucugcaucuga

SEQ ID NO: 13762 - RNA, 1701 nt, Artificial Sequence
  derived and/or modified CDS sequence (AUadapt) from InfluenzaA__ALE32032__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucgccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggcgugcccccgcuacgugaagcacagcacgcugaagcuggccaccggcaugcggaacguccccgagaagcagacccgcgggaucuucggcgccaucgccggguucaucgagaacggcugggagggcaugauggacgggugguacggcuuccggcaccagaacuccgaggggcgcggccaggccgcggaccucaagucgacccaggccgccaucgaccagaucaacgggaagcugaaccggcugaucggcaagacgaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacaccaucgaccugaccgacuccgagaugaacaagcuguucgagaagacgaagaagcagcuccgcgagaacgcggaggacauggggaacggcugcuucaagaucuaccacaagugcgacaacgccugcaucgggucgauccggaacggcaccuacgaccacaacguguaccgcgacgaggcccugaacaaccgguuccagaucaaggggguggagcucaaguccggcuacaaggacuggauccuguggaucagcuucgccaucagcugcuuccugcucugcgucgcccugcugggcuucaucaugugggcgugccagaaggggaacauccgcugcaacaucugcaucuga

SEQ ID NO: 13763 - RNA, 1701 nt, Artificial Sequence; identical to SEQ ID NO: 68
  derived and/or modified CDS sequence (AUadapt) from InfluenzaA__ALE32033__HA

SEQ ID NO: 13764 - RNA, 1701 nt, Artificial Sequence
  derived and/or modified CDS sequence (AUadapt) from InfluenzaA__ALE32034__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccucaaguacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13765 - RNA, 1701 nt, Artificial Sequence; identical to SEQ ID NO: 13576
  derived and/or modified CDS sequence (AUadapt) from InfluenzaA__ALE32035__HA

SEQ ID NO: 13766 - RNA, 1701 nt, Artificial Sequence
  derived and/or modified CDS sequence (AUadapt) from InfluenzaA__ALE32036__HA
augaagaccaucaucgcccugggcuacauccucugccugguguucgcccagaagauccccgggaacgacaacucgaccgcgacgcugugccucggccaccacgccgucccgaacgggaccaucgugaagaccaucaccaacgaccgcaucgaggugacgaacgccaccgagcugguccagaacuccagcaucggcgagaucugcgacucgccccacaagauccuggacggggagaacugcacccucaucgacgcccugcugggcgacccccagugcgacggcuuccagaacaagaagugggaccucuucguggagcgguccaaggccuacuccaacugcuaccccuacgacgugccggacuacgcgagccugcgcucccuggucgccucguccgggacccucgaguucaacaacgagagcuucaacuggacgggcgugacccagaacgggaccuccucggccugcauccggcgcuccagcuccucguucuucucccggcugaacuggcugacccaccuccacuacacguaccccgcccugaacgugaccaugcccaacaacgagcaguucgacaagcuguacaucuggggcguccaccaccccgggaccgacaaggaccagaucuuccucuacgcgcagagcuccggccgcaucaccgugucgacgaagcggagccagcaggccgugaucccgaacaucggcucccgcccccggauccgcgacauccccucgcggaucuccaucuacuggaccaucgucaagcccggggacauccugcugaucaacagcaccggcaaccucaucgccccgcgcggguacuucaagauccgguccggcaagucguccaucaugcgcagcgacgcccccaucggcaagugcaaguccgagugcaucacccccaacgggucgauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacggcugggaggggaugguggacggcugguacggguuccggcaccagaacagcgagggccgcgggcaggccgccgaccucaaguccacgcaggcggccaucgaccagaucaacggcaagcugaaccggcugaucggcaagaccaacgagaaguuccaccagaucgagaaggaguucucggagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagucgggcuacaaggacuggauccuguggaucuccuucgccaucagcugcuuccugcucugcguggcccugcugggguucaucaugugggccugccagaagggcaacauccgcugcaacaucugcaucuga

SEQ ID NO: 13767 - RNA, 1701 nt, Artificial Sequence
  derived and/or modified CDS sequence (AUadapt) from InfluenzaA__ALE32037__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccagcgggcgcaucaccgugucgaccaagcggucccagcaggccgugaucccgaacaucggcagccgcccccggauccgcgacauccccucccggaucucgaucuacuggacgaucgucaagcccggcgacauccugcugaucaacuccaccgggaaccucaucgccccgcgcggcuacuucaagauccugagcgggaaguccagcaucaugcgguccgacgcccccaucggcaagugcaagucggagugcaucacccccaacggcuccauccccaacgacaagccguuccagaacgugaaccgcaucaccuacggggccugcccccgguacgugaagcacagcacgcugaagcucgcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacccaggcggccaucgaccagaucaacgggaagcugaaccgccugaucggcaagacgaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccgcaacggcaccuacgaccacaacguguaccgggacgaggcccucaacaaccgcuuccagaucaagggggucgagcugaaguccggcuacaaggacuggauccuguggaucagcuucgccaucagcugcuuccuccugugcguggcccugcucggcuucaucaugugggccugccagaaggggaacauccggugcaacaucugcaucuga

SEQ ID NO: 13768 - RNA, 1701 nt, Artificial Sequence
  derived and/or modified CDS sequence (AUadapt) from InfluenzaA__ALE32038__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaaggggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccucaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgaagaagcagcugcgcgagaacgccgaggacauggggaacggcugcuucaagaucuaccacaagugcgacaacgcgugcaucgggucgauccggaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13769 - RNA, 1701 nt, Artificial Sequence; identical to SEQ ID NO: 13344
  derived and/or modified CDS sequence (AUadapt) from InfluenzaA__ALE32039__HA

SEQ ID NO: 13770 - RNA, 1701 nt, Artificial Sequence
  derived and/or modified CDS sequence (AUadapt) from InfluenzaA__ALE32040__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaccuccagcaucaugcgcuccgacgcccccaucggcaagugcaagucggagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13771 - RNA, 1701 nt, Artificial Sequence; identical to SEQ ID NO: 68
  derived and/or modified CDS sequence (AUadapt) from InfluenzaA__ALE32041__HA

SEQ ID NO: 13772 - RNA, 1701 nt, Artificial Sequence; identical to SEQ ID NO: 68
  derived and/or modified CDS sequence (AUadapt) from InfluenzaA__ALE32042__HA

SEQ ID NO: 13773 - RNA, 1701 nt, Artificial Sequence
  derived and/or modified CDS sequence (AUadapt) from InfluenzaA__ALE32043__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacaccucccugcgcucgcuggucgcguccagcggcacgcucgaguucaacaacgaguccuucaacuggaccggggugacccagaacggcaccucguccgccugcauccggcgcagcuccucguccuucuucagccggcugaacuggcugacgcaccucaacuacaccuaccccgcccugaacgugaccaugcccaacaacgagcaguucgacaagcuguacaucuggggcguccaccaccccgggaccgacaaggaccagaucuuccucuacgcccaguccucggggcgcaucacggugagcaccaagcggucccagcaggcggugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacgcccaacggcuccauccccaacgacaagccguuccagaacgugaaccggaucaccuacggggccugcccccgcuacgugaagcacagcacccugaagcuggccaccggcaugcggaacguccccgagaagcagacgcgcgggaucuucggcgcgaucgccggguucaucgagaacggcugggagggcaugguggacgggugguacggcuuccggcaccagaacuccgaggggcgcggccaggccgccgaccucaagucgacccaggccgcgaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacguguaccgcgacgaggcgcugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13774 - RNA, 1701 nt, Artificial Sequence; identical to SEQ ID NO: 68
  derived and/or modified CDS sequence (AUadapt) from InfluenzaA__ALE32044__HA

SEQ ID NO: 13775 - RNA, 1701 nt, Artificial Sequence; identical to SEQ ID NO: 68
  derived and/or modified CDS sequence (AUadapt) from InfluenzaA__ALE32045__HA

SEQ ID NO: 13776 - RNA, 1701 nt, Artificial Sequence; identical to SEQ ID NO: 68
  derived and/or modified CDS sequence (AUadapt) from InfluenzaA__ALE32046__HA

SEQ ID NO: 13777 - RNA, 1701 nt, Artificial Sequence
  derived and/or modified CDS sequence (AUadapt) from InfluenzaA__ALE32047__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccaggugcuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcagccugguggccuccucgggcacccucgaguucaacaacgaguccuucaacuggacgggggugacccagaacggcaccagcuccgccugcauccggcgcucguccagcuccuucuucagccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcaguccucggggcgcaucaccgugagcacgaagcggucccagcaggccgucaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggagcgggaaguccucgaucaugaucuccgacgcccccaucggcaagugcaagagcgagugcaucacccccaacggcuccauccccucggacaagccguuccagaacgugaaccgcaucacguacggggccugcccccgguacgucaagcacuccacccugaagcuggcgaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccucaaguccacgcaggcggccaucgaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccgcaacggcaccuacgaccacaacgucuaccgggacgaggcccugaacaaccgcuuccagaucaaggggguggagcucaagagcggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 13778 - RNA, 1701 nt, Artificial Sequence; identical to SEQ ID NO: 68
  derived and/or modified CDS sequence (AUadapt) from InfluenzaA__ALE32048__HA

SEQ ID NO: 13779 - RNA, 1701 nt, Artificial Sequence; identical to SEQ ID NO: 13344
  derived and/or modified CDS sequence (AUadapt) from InfluenzaA__ALE32049__HA

SEQ ID NO: 13780 - RNA, 1701 nt, Artificial Sequence
  derived and/or modified CDS sequence (AUadapt) from InfluenzaA__ALE32050__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccaggacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13781 - RNA, 1701 nt, Artificial Sequence
  derived and/or modified CDS sequence (AUadapt) from InfluenzaA__ALE32051__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccgggugacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaucaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13782 - RNA, 1701 nt, Artificial Sequence; identical to SEQ ID NO: 68
  derived and/or modified CDS sequence (AUadapt) from InfluenzaA__ALE32052__HA

SEQ ID NO: 13783 - RNA, 1701 nt, Artificial Sequence; identical to SEQ ID NO: 68
  derived and/or modified CDS sequence (AUadapt) from InfluenzaA__ALE32053__HA

SEQ ID NO: 13784 - RNA, 1701 nt, Artificial Sequence
  derived and/or modified CDS sequence (AUadapt) from InfluenzaA__ALE32054__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgagagcccccaccagauccuggacggcgagaacugcacccucaucgacgcccugcugggggacccccagugcgacggcuuccagaacaagaagugggaccucuucguggagcgguccaaggccuacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagggcucccagcaggccgugaucccgaacaucggcagccggccccgcauccgggacauccccucccgcaucucgaucuacuggaccaucgucaagcccggggacauccugcugaucaacuccaccggcaaccucaucgccccgcggggguacuucaagauccgcagcggcaaguccucgaucaugcgguccgacgcccccaucggcaagugcaagagcgagugcaucacccccaacggguccauccccaacgacaagccguuccagaacgugaaccgcaucacguacggcgccugcccccgguacgugaagcacucgacccugaagcuggcgaccgggaugcgcaacguccccgagaagcagacccggggcaucuucggggccaucgccggcuucaucgagaacggcugggaggggaugguggacggcugguacggguuccgccaccagaacuccgagggccgggggcaggccgccgaccucaagagcacgcaggcggccaucgaccagaucaacggcaagcugaaccgccugaucggcaagaccaacgagaaguuccaccagaucgagaaggaguucuccgagguggaggggcggauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccgcaacgggaccuacgaccacaacguguaccgggacgaggcccugaacaaccgcuuccagaucaagggcgucgagcucaaguccggcuacaaggacuggauccuguggaucucguucgccaucagcugcuuccugcucugcguggcccugcugggguucaucaugugggccugccagaagggcaacauccggugcaaccacugcaucuga

SEQ ID NO: 13785 - RNA, 1701 nt, Artificial Sequence
  derived and/or modified CDS sequence (AUadapt) from InfluenzaA__ALE32055__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcaguccucggggcgcaucaccgugagcaccaagcggucccagcaggccgugaucccgaacaucggcucgcgcccccggauccgcgacauccccucccggaucagcaucuacuggacgaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucaccuacggggccugcccccgcuacgugaagcacagcacgcugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagaagacgaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaacgggaacauccgcugcaacaucugcaucuga

SEQ ID NO: 13786 - RNA, 1701 nt, Artificial Sequence; identical to SEQ ID NO: 13337
  derived and/or modified CDS sequence (AUadapt) from InfluenzaA__ALE32056__HA

SEQ ID NO: 13787 - RNA, 1701 nt, Artificial Sequence
  derived and/or modified CDS sequence (AUadapt) from InfluenzaA__ALE32057__HA
augaagaccaucaucgcccugucguacgugcucugccuggucuucgcccagaagauccccggcaacgacaacuccaccgcgacgcugugccucgggcaccacgccgugccgaacggcaccaucgugaagaccaucaccaacgaccgcaucgaggucacgaacgccaccgagcuggugcagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgucccggacuacgcgucccugcgcucgcugguggccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgucaccaugcccaacaacgagcaguucgacaagcuguacaucuggggcgugcaccaccccgggaccgacaaggaccagaucuuccucuacgcgcaguccucggggcgcaucaccgugagcacgaagcggucccagcaggccgucaucccgaacaucggcucgcgcccccggauccgcgacauccccucccggaucagcaucuacuggaccaucgugaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13788 - RNA, 1701 nt, Artificial Sequence; identical to SEQ ID NO: 68
  derived and/or modified CDS sequence (AUadapt) from InfluenzaA__ALE32058__HA

SEQ ID NO: 13789 - RNA, 1701 nt, Artificial Sequence; identical to SEQ ID NO: 68
  derived and/or modified CDS sequence (AUadapt) from InfluenzaA__ALE32059__HA

SEQ ID NO: 13790 - RNA, 1701 nt, Artificial Sequence
  derived and/or modified CDS sequence (AUadapt) from InfluenzaA__ALE32060__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagguguuccucuacgcgcaguccucggggcgcaucaccgugagcacgaagcggucccagcaggccgucaucccgaacaucggcucgcgcccccggauccgcgacauccccucccggaucagcaucuacuggaccaucgugaagcccggcgacauccugcugauccacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgucaagcacagcacccugaagcuggcgaccggcaugcggaacgugcccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacgucuaccgcgacgaggcccugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13791 - RNA, 1701 nt, Artificial Sequence
  derived and/or modified CDS sequence (AUadapt) from InfluenzaA__ALE32061__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaaguacacguaccccgcccugaacgugaccaugcccaacaacgagcaguucgacaagcuguacaucuggggcguccaccaccccgggaccgacaacgaccagaucuuccucuacgcgcgcuccucggggcggaucaccgugagcacgaagggcucccagcaggccgugaucccgaacaucggcucgcgcccccggauccgcgacauccccucccggaucagcaucuacuggaccaucgucaagcccggggacauccugcugaucaacuccaccggcaaccucaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucacguacggcgccugcccccgcuacgugaagcacagcacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagucgacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcucgauccggaacgggaccuacgaccacaacguguaccgcgacgaggcccugaacaaccgguuccagaucaagggcgucgagcucaaguccggcuacaaggacuggauccuguggaucagcuucgccaucagcugcuuccugcucugcguggcccugcugggguucaucaugugggccugccagaagggcaacauccgcugcaacaucugcaucuga

SEQ ID NO: 13792 - RNA, 1701 nt, Artificial Sequence
  derived and/or modified CDS sequence (AUadapt) from InfluenzaA__ALE32062__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucuacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13793 - RNA, 1701 nt, Artificial Sequence; identical to SEQ ID NO: 68
  derived and/or modified CDS sequence (AUadapt) from InfluenzaA__ALE32063__HA

SEQ ID NO: 13794 - RNA, 1701 nt, Artificial Sequence
  derived and/or modified CDS sequence (AUadapt) from InfluenzaA__ALE32064__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccaacucguucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcagagcuccgggcgcaucaccgugucgacgaagcggagccagcaggccgugaucccgaacaucggcucccgcccccggauccgcgacauccccucgcggaucuccaucuacuggaccaucgucaagcccggcgacauccugcugaucaacagcaccgggaaccucaucgccccgcgcggcuacuucaagauccgguccggcaagucguccaucaugcgcagcgacgcccccaucgggaagugcaaguccgagugcaucacccccaacggcucgauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacagcgaggggcgcggccaggccgccgaccucaaguccacgcaggcggccaucgaccagaucaacgggaagcugaaccggcugaucggcaagaccaacgagaaguuccaccagaucgagaaggaguucucggagguggagggccgcauccaggaccucgagaaguacgucgaggacaccaagaucgaccugugguccuacaacgccgagcugcucguggcccuggagaaccagcacaccaucgaccugacggacagcgagaugaacaagcuguucgagaagaccaagaagcagcuccgcgagaacgccgaggacaucgggaacggcugcuucaagaucuaccacaagugcgacaacgcgugcaucggguccauccggaacggcaccuacgaccacaacguguaccgcgacgaggcccugaacaaccgguuccagaucaagggggucgagcucaagucgggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 13795 - RNA, 1701 nt, Artificial Sequence; identical to SEQ ID NO: 68
  derived and/or modified CDS sequence (AUadapt) from InfluenzaA__ALE32065__HA

SEQ ID NO: 13796 - RNA, 1701 nt, Artificial Sequence
  derived and/or modified CDS sequence (AUadapt) from InfluenzaA__ALE32066__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacguguccaugcccaacaacgagcaguucgacaagcuguacaucuggggcguccaccaccccgggaccgacaaggaccagaucuuccucuacgcgcagagcucggggcgcaucaccguguccaccaagcggagccagcaggccgugaucccgaacaucggcucccgcccccggauccgcgacauccccucgcggaucuccaucuacuggacgaucgucaagcccggcgacauccugcugaucaacagcaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucaccuacggggccugcccccgcuacgugaagcacuccacgcugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacccaggcggccaucgaccagaucaacgggaagcugaaccggcugaucggcaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacucggagaugaacaagcuguucgagaagacgaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13797 - RNA, 1701 nt, Artificial Sequence; identical to SEQ ID NO: 13468
  derived and/or modified CDS sequence (AUadapt) from InfluenzaA__ALE32067__HA

SEQ ID NO: 13798 - RNA, 1701 nt, Artificial Sequence; identical to SEQ ID NO: 68
  derived and/or modified CDS sequence (AUadapt) from InfluenzaA__ALE32068__HA

SEQ ID NO: 13799 - RNA, 1701 nt, Artificial Sequence; identical to SEQ ID NO: 68
  derived and/or modified CDS sequence (AUadapt) from InfluenzaA__ALE32069__HA

SEQ ID NO: 13800 - RNA, 1701 nt, Artificial Sequence
  derived and/or modified CDS sequence (AUadapt) from InfluenzaA__ALE32070__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggugugcccccgcuacgucaagcacagcacccugaagcuggccaccggcaugcggaacgugcccgagaagcagacccgcgggaucuucggcgcgaucgccggguucaucgagaacggcugggagggcaugguggacgggugguacggcuuccggcaccagaacuccgaggggcgcggccaggccgccgaccucaagucgacgcaggccgcgaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgccugcaucgggucgauccggaacggcaccuacgaccacaacgucuaccgcgacgaggcgcugaacaaccgguuccagaucaaggggguggagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13801 - RNA, 1701 nt, Artificial Sequence; identical to SEQ ID NO: 68
  derived and/or modified CDS sequence (AUadapt) from InfluenzaA__ALE32071__HA

SEQ ID NO: 13802 - RNA, 1701 nt, Artificial Sequence; identical to SEQ ID NO: 13683
  derived and/or modified CDS sequence (AUadapt) from InfluenzaA__ALE32072__HA

SEQ ID NO: 13803 - RNA, 1701 nt, Artificial Sequence
  derived and/or modified CDS sequence (AUadapt) from InfluenzaA__ALE32073__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccagcgggcggaucaccgugucgacgaagcgcucccagcaggccgugaucccgaacaucggcagccggccccgcauccgggacauccccucccgcaucucgaucuacuggaccaucgucaagcccggcgacauccugcugaucaacuccaccgggaaccucaucgccccgcggggcuacuucaagauccugagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagaagaccaagaagcagcugcgggagaacgccgaggacauggggaacggcugcuucaagaucuaccacaagugcgacaacgcgugcaucgggucgauccgcaacggcaccuacgaccacaacguguaccgcgacgaggcccucaacaaccgguuccagaucaagggggucgagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13804 - RNA, 1701 nt, Artificial Sequence
  derived and/or modified CDS sequence (AUadapt) from InfluenzaA__ALE32074__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcagccuggucgccuccucgggcacccucgaguucaacaacgaguccuucaacuggacgggggugacccagaacggcaccagcuccucgugcauccggcgcuccagcuccagcuucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcccagucgagcgggcgcaucaccguguccacgaagcggucgcagcaggcggugaucccgaacaucggcucccgcccccggauccgcgacauccccagccggaucuccaucuacuggaccaucgucaagcccggcgacauccugcugaucaacagcaccgggaaccucaucgccccgcgcggcuacuucaagauccuguccggcaagucguccaucaugcggagcgacgcccccaucgggaagugcaaguccgagugcaucacccccaacggcucgauccccaacgacaagccguuccagaacgugaaccgcaucacguacggggccugcccccgguacgugaagcacuccacccugaagcucgccaccggcaugcgcaacguccccgagaagcagacccgggggaucuucggcgcgaucgccggguucaucgagaacggcugggagggcaugguggacgggugguacggcuuccgccaccagaacagcgaggggcggggccaggccgccgaccugaaguccacgcaggccgcgaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacucggagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacaacguguaccgggacgaggcgcucaacaaccgcuuccagaucaagggggucgagcucaagagcggcuacaaggacuggauccuguggaucagcuucgccaucuccugcuuccugcugugcguggcccugcucggcuucaucaugugggccugccagaaggggaacauccggugcaacaucugcaucuga

SEQ ID NO: 13805 - RNA, 1701 nt, Artificial Sequence
  derived and/or modified CDS sequence (AUadapt) from InfluenzaA__ALE32075__HA
augaagaccaucaucgcccugucguacauccucugccugguguucgcccagaagcugcccgagaacgacaacuccaccgcgacgcucugccugggccaccacgccgucccgaacgggaccaucgugaagaccaucaccagcgaccgcaucgaggugacgaacgccaccgagcugguccagaacuccucgaucggcgagaucugcgacagcccccaccagauccucgacgggaagaacugcacccugaucgacgcccugcucggcgacccccagugcgacggguuccagaacaagaagugggaccuguucguggagcgguccaaggccuacuccaacugcuaccccuacgacgugccggacuacgcgucgcugcgcucccucgucgccagcuccggcacccuggaguucaacgacgagucguucaacugggccggcgugacgcagaacgggaccuccagcuccugcauccggggcucgaacuccagcuucuucucccgccugaacuggcucacccacucgaacuucaaguaccccgcccugaacgugaccaugcccaacaacgagcaguucgacaagcuguacaucuggggcguccaccaccccgggacggacaaggaccagaucuuccucuacgcgcagagcuccgggcggaucaccgugagcaccaagcgcucccagcaggccgugaucccgaacaucggcucgcggccccgcauccggaacauccccucccgcaucagcaucuacuggaccaucgucaagcccggcgacauccugcugaucaacuccacggggaaccucaucgccccgcggggcuacuucaagauccgcucggggaaguccagcaucaugcgguccgacgcccccaucggcaagugcaagucggagugcaucacccccaacggcuccauccccaacgacaagccguuccagaacgugaaccgcaucaccuacggggccugcccccgguacgugaagcagagcacccugaagcuggcgacgggcaugcgcaacguccccgagaagcagacccgggggaucuucggcgccaucgccggguucaucgagaacggcugggagggcaugaaggacgggugguacggcuuccgccaccagaacuccgaggggcggggccaggccgccgaccucaagucgacccaggcggccaucgaccagaucaacgggaagcugaaccgccugaucggcaagaccaacgagaaguuccaccagaucgagaaggaguucuccgagguggagggccggauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccgcaacggcacguacgaccacgacguguaccgggacgaggcccugaacaaccgcuuccagaucaaggggguggagcucaagagcggcuacaaggacuggauccuguggaucuccuucgccaucagcugcuuccugcucugcgucgcccugcugggcuucaucaugugggccugccagaaggggaacauccggugcaacaucugcaucuga

SEQ ID NO: 13806 - RNA, 1701 nt, Artificial Sequence; identical to SEQ ID NO: 13243
  derived and/or modified CDS sequence (AUadapt) from InfluenzaA__ALE32076__HA

SEQ ID NO: 13807 - RNA, 1701 nt, Artificial Sequence
  derived and/or modified CDS sequence (AUadapt) from InfluenzaA__ALE32077__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacucguccaucggggagaucugcgacagcccccaccagauccuggacggcgagaacugcacccucaucgacgcccugcugggggacccccagugcgacggcuuccagaacaagaagugggaccucuucguggagcgguccaaggcccacucgaacugcuaccccuacgacgugccggacuacgcgucccugcgcagccuggucgccuccucgggcacccucgaguucaacaacgaguccuucaacuggacgggggugacccagaacggcaccagcuccgccugcauccggcgcucguccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgcuccagcgggcggaucaccgugucgacgaagggcucccagcaggccgugaucccgaacaucggcagccgcccccggauccgcgacauccccucccggaucucgaucuacuggaccaucgucaagcccggggacauccugcugaucaacuccaccggcaaccucaucgccccgcgcggguacuucaagauccggagcggcaaguccucgaucaugcgcuccgacgcccccaucggcaagugcaagagcgagugcaucacccccaacggguccauccccaacgacaagccguuccagaacgugaaccggaucacguacggcgccugcccccgcuacgugaagcacucgacccugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagagcacgcaggcggccaucgaccagaucaacggcaagcugaaccggcugaucggcaagaccaacgagaaguuccaccagaucgagaaggaguucuccgagguggaggggcgcauccaggaccucgagaaguacgucgaggacaccaagaucgaccuguggucguacaacgccgagcugcucguggcccuggagaaccagcacaccaucgaccugacggacuccgagaugaacaagcuguucgagaagaccaagaagcagcuccgcgagaacgccgaggacaugggcaacgggugcuucaagaucuaccacaagugcgacaacgcgugcaucggcagcauccggaacgggaccuacgaccacaacguguaccgcgacgaggcccugaacaaccgguuccagaucaagggcgucgagcucaaguccggcuacaaggacuggauccuguggaucucguucgccaucagcugcuuccugcucugcguggcccugcugggguucaucaugugggccugccagaagggcaacauccgcugcaacaucugcaucuga

SEQ ID NO: 13808 - RNA, 1701 nt, Artificial Sequence; identical to SEQ ID NO: 13344
  derived and/or modified CDS sequence (AUadapt) from InfluenzaA__ALE32078__HA

SEQ ID NO: 13809 - RNA, 1701 nt, Artificial Sequence; identical to SEQ ID NO: 13230
  derived and/or modified CDS sequence (AUadapt) from InfluenzaA__ALE32079__HA

SEQ ID NO: 13810 - RNA, 1701 nt, Artificial Sequence
  derived and/or modified CDS sequence (AUadapt) from InfluenzaA__ALE32080__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccagcugcauccggcgcuccagcuccucguucuucucccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcccagagcucggggcgcaucaccguguccacgaagcggagccagcaggcggugaucccgaacaucggcucccgcccccggauccgcgacauccccucgcggaucuccaucuacuggaccaucgucaagcccggcgacauccugcugaucaacagcaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcacuccacccugaagcuggccaccggcaugcggaacguccccgagaagcagacccgcgggaucuucggcgcgaucgccggguucaucgagaacggcugggagggcaugguggacgggugguacggcuuccggcaccagaacucggaggggcgcggccaggccgccgaccucaaguccacgcaggccgcgaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgccugcaucggguccauccggaacggcaccuacgaccacaacguguaccgcgacgaggcgcugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13811 - RNA, 1701 nt, Artificial Sequence; identical to SEQ ID NO: 13344
  derived and/or modified CDS sequence (AUadapt) from InfluenzaA__ALE32081__HA

SEQ ID NO: 13812 - RNA, 1701 nt, Artificial Sequence; identical to SEQ ID NO: 13344
  derived and/or modified CDS sequence (AUadapt) from InfluenzaA__ALE32082__HA

SEQ ID NO: 13813 - RNA, 1701 nt, Artificial Sequence
  derived and/or modified CDS sequence (AUadapt) from InfluenzaA__ALE32083__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacaaguaccccgcccugaacgugacgaugcccaacaacgagcaguucgacaagcuguacaucuggggcguccaccaccccgggaccgacaaggaccagaucuuccucuacgcgcgcuccucggggcggaucaccgugagcaccaagggcucccagcaggccgugaucccgaacaucggcucgcgcccccggauccgcgacauccccucccggaucagcaucuacuggacgaucgucaagcccggggacauccugcugaucaacuccaccggcaaccucaucgccccgcgcggguacuucaagauccggucgggcaaguccagcaucaugcgcuccgacgcccccaucggcaagugcaagucggagugcaucacccccaacggguccauccccaacgacaagccguuccagaacgugaaccggaucaccuacggcgccugcccccgcuacgugaagcacagcacgcugaagcuggcgaccgggaugcggaacguccccgagaagcagacccgcggcaucuucggggccaucgccggcuucaucgagaacggcugggaggggaugguggacggcugguacggguuccggcaccagaacuccgagggccgcgggcaggccgccgaccucaagucgacccaggcggccaucgaccagaucaacggcaagcugaaccggcugaucggcaagacgaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugaccgacuccgagaugaacaagcuguucgagcgcacgaagaagcagcuccgggagaacgccgaggacaugggcaacgggugcuucaagaucuaccacaagugcgacaacgcgugcaucggcucgauccgcaacgggaccuacgaccacaacguguaccgggacgaggcccugaacaaccgcuuccagaucaagggcgucgagcucaaguccggcuacaaggacuggauccuguggaucagcuucgccaucagcugcuuccugcucugcguggcccugcugggguucaucaugugggccugccagaagggcaacauccggugcaacaucugcaucuga

SEQ ID NO: 13814 - RNA, 1701 nt, Artificial Sequence; identical to SEQ ID NO: 13301
  derived and/or modified CDS sequence (AUadapt) from InfluenzaA__ALE32084__HA

SEQ ID NO: 13815 - RNA, 1701 nt, Artificial Sequence; identical to SEQ ID NO: 13344
  derived and/or modified CDS sequence (AUadapt) from InfluenzaA__ALE32085__HA

SEQ ID NO: 13816 - RNA, 1701 nt, Artificial Sequence
  derived and/or modified CDS sequence (AUadapt) from InfluenzaA__ALE32086__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcugaucaacuccaccgggaaccucaucgccccgcgcggcuacuucaagauccggagcgggaaguccagcaucaugcgcuccgacgcccccaucucgaagugcaaguccgagugcaucacccccaacggcagcauccccaacgacaagccguuccagaacgugaaccggaucacguacggcgccugcccccgcuacgugaagcacuccacccugaagcuggcgaccgggaugcggaacguccccgagaagcagacccgcggcaucuucggggccaucgccggcuucaucgagaacgggugggagggcaugguggacggcugguacggguuccggcaccagaacucggagggccgcgggcaggccgccgaccucaaguccacgcaggcggccaucgaccagaucaacggcaagcugaaccggcugaucgggaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacaacguguaccgcgacgaggcccugaacaaccgguuccagaucaagggcgucgagcucaagagcggguacaaggacuggauccuguggaucagcuucgccaucuccugcuuccugcucugcguggcccugcugggcuucaucaugugggccugccagaagggcaacauccgcugcaacaucugcaucuga

SEQ ID NO: 13817 - RNA, 1701 nt, Artificial Sequence
  derived and/or modified CDS sequence (AUadapt) from InfluenzaA__ALE32087__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccucguccuucuucagccggcugaacuggcugacccaccucgacuacacguaccccgcccugaacgugaccaugcccaacaacgagcaguucgacaagcuguacaucuggggcguccaccaccccgggaccgacaaggaccagaucuuccucuacgcgcgguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcuggcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaaccugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13818 - RNA, 1701 nt, Artificial Sequence
  derived and/or modified CDS sequence (AUadapt) from InfluenzaA__ALE32088__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccgcaagagcuccagcuccuucuucucgcggcugaacuggcugacccaccucaacuacacguaccccgcccugaacgugaccaugcccaacaacgagcaguucgacaagcuguacaucuggggcguccuccaccccgggaccgacaaggaccagaucuuccuguacgcgcgguccagcgggcgcaucaccgugucgacgaagcggucccagcaggccgugaucccgaacaucggcagccgcccccggauccgcgacauccccucccggaucucgaucuacuggaccaucgucaagcccggcgacauccugcucaucaacuccaccgggaaccugaucgccccgcgcggcuacuucaagauccggagcgggaaguccagcaucaugcgcuccgacgcccccaucggcaagugcaagucggagugcaucacccccaacggcuccauccccaacgacaagccguuccagaacgugaaccggaucacguacggggccugcccccgcuacgugaagcacagcacccugaagcucgcgaccggcaugcggaacguccccgagaagcagacccgcgggaucuucggcgccaucgccggguucaucgagaacggcugggagggcaugguggacgggugguacggcuuccggcaccagaacuccgaggggcgcggccaggccgccgaccucaagucgacgcaggcggccaucgaccagaucaacgggaagcugaaccggcugaucggcaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccguggaccucacggacuccgagaugaacaagcuguucgagaagaccaagaagcagcugcgcgagaacgccgaggacauggggaacggcugcuucaagaucuaccacaagugcgacaacgcgugcaucgggucgauccggaacggcaccuacgaccacaacgucuaccgcgacgaggcccucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 13819 - RNA, 1701 nt, Artificial Sequence; identical to SEQ ID NO: 68
  derived and/or modified CDS sequence (AUadapt) from InfluenzaA__ALE32089__HA

SEQ ID NO: 13820 - RNA, 1701 nt, Artificial Sequence; identical to SEQ ID NO: 68
  derived and/or modified CDS sequence (AUadapt) from InfluenzaA__ALE32090__HA

SEQ ID NO: 13821 - RNA, 1701 nt, Artificial Sequence; identical to SEQ ID NO: 68
  derived and/or modified CDS sequence (AUadapt) from InfluenzaA__ALE32091__HA

SEQ ID NO: 13822 - RNA, 1701 nt, Artificial Sequence
  derived and/or modified CDS sequence (AUadapt) from InfluenzaA__ALE32092__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaacuccaccgggaaccucaucgccccgcgcggcuacuucaagauccggucggggaaguccagcaucaugcgcuccgacgcccccaucggcaagugccggucggagugcaucacccccaacggcuccauccccaacgacaagccguuccagaacgugaaccgcaucacguacggggccugcccccgguacgugaagcacagcacccugaagcuggcgaccggcaugcgcaacguccccgagaagcagacccgggggaucuucggcgccaucgccggguucaucgagaacggcugggagggcaugguggacgggugguacggcuuccgccaccagaacuccgaggggcggggccaggccgccgaccucaagucgacgcaggcggccaucgaccagaucaacgggaagcugaaccgccugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggucgauccgcaacggcaccuacgagcacaacguguaccgggacgaggcccugaacaaccgcuuccagaucaagggggucgagcucaaguccggcuacaaggacuggauccuguggaucagcuucgccaucagcugcuuccugcucugcguggcccugcugggcuucaucaugugggccugccagaaggggaacauccggugcaacaucugcaucuga

SEQ ID NO: 13823 - RNA, 1701 nt, Artificial Sequence; identical to SEQ ID NO: 13292
  derived and/or modified CDS sequence (AUadapt) from InfluenzaA__ALE32093__HA

SEQ ID NO: 13824 - RNA, 1701 nt, Artificial Sequence
  derived and/or modified CDS sequence (AUadapt) from InfluenzaA__ALE32094__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccucguccuucuucagccggcugaacuggcugacccaccucaacuacacguaccccgcccugaacgugaccaugcccaacaacgagcaguucgacaagcuguacaucuggggcguccaccaccccgggaccgacaaggaccagaucuuccucuacgcgcaguccucggggcgcaucaccgugagcacgaagcggucccagcaggccgugaucccgaacaucggcucgcgcccccggauccgcgacauccccucccggaucagcaucuacuggaccaucgucaagcccggcgacauccugcugaucaccuccaccgggaaccucaucgccccgcgcggcuacuucaagauccggucggggaaguccagcaucaugcgcuccgacgcccccaucggcaagugcaagucggagugcaucacgcccaacggcuccauccccaacgacaagccguuccagaacgugaaccggaucaccuacggggccugcccccgcuacgugaagcacagcacccugaagcuggcgaccggcaugcggaacguccccgagaagcagacgcgcgggaucuucggcgccaucgccggguucaucgagaacggcugggagggcaugguggacgggugguacggcuuccggcaccagaacuccgaggggcgcggccaggccgccgaccucaagucgacccaggcggccaucgaccagaucaacgggaagcugaaccggcugaucggcaagaccaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggucgauccggaacggcaccuacgaccacaacguguaccgcgacgaggcccugaacaaccgguuccagaucaagggggucgagcucaaguccggcuacaaggacuggauccuguggaucagcuucgccaucagcugcuuccugcucugcguggcccugcugggcuucaucaugugggccugccagaaggggaacauccgcugcaacaucugcaucuga

SEQ ID NO: 13825 - RNA, 1701 nt, Artificial Sequence; identical to SEQ ID NO: 68
  derived and/or modified CDS sequence (AUadapt) from InfluenzaA__ALE32095__HA

SEQ ID NO: 13826 - RNA, 1701 nt, Artificial Sequence
  derived and/or modified CDS sequence (AUadapt) from InfluenzaA__ALE32096__HA
augaagaccaucaucgcccugucguacauccucugccugguguucgcccagaagauccccggcaacgacaacuccaccgcgacgcugugccucgggcaccacgccgucccgaacggcaccaucgugaagaccaucaccaacgaccgcaucgaggugacgaacgccaccgagcugguccagaacagcuccaucggggagaucugcgacucgccccaccagauccuggacggcgagaacugcacccucaucgacgcccugcugggggacccccagugcgacggcuuccagaacaagaagugggaccucuucguggagcgguccaaggccuacagcaacugcuaccccuacgacgugccggacuacgcgucccugcgcucgcuggucgccuccagcggcacccucgaguucaacaacgaguccuucaacuggacgggggugacccagaacggcaccucguccgccugcauccggcgcagcuccagcuccuucuucucgcggcugaacuggcugacccaccucuccuacacguaccccgcccugaacgugaccaugcccaacaacgagcaguucgacaagcuguacaucuggggcguccaccaccccgggaccgacaaggaccagaucuuccucuacgcgcagagcucggggcgcaucaccguguccacgaagcggagccagcaggccgugaucccgaacaucggcucccgcccccggauccgcgacauccccucgcggaucuccaucuacuggaccaucgucaagcccggcgacauccugcugaucaacagcaccgggaaccucaucgccccgcgcggcuacuucaagauccgguccggcaagagcuccaucaugcgcucggacgcccccaucgggaagugcaaguccgagugcaucacccccaacggcagcauccccaacgacaagccguuccagaacgugaaccggaucacguacggggccugcccccgcuacgugaagcacuccacccugaagcuggcgaccggcaugcggaacguccccgagaagcagacccgcgggaucuucggcgccaucgccggguucaucgagaacggcugggagggcaugguggacgggugguacggcuuccggcaccagaacucggaggggcgcggccaggccgccgaccucaaguccacgcaggcggccaucgaccagaucaacgggaagcugaaccggcugaucggcaagaccaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugacggacucggagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacguguaccgcgacgaggcccugaacaaccgguuccagaucaagggggucgagcucaagagcggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 13827 - RNA, 1701 nt, Artificial Sequence; identical to SEQ ID NO: 68
  derived and/or modified CDS sequence (AUadapt) from InfluenzaA__ALE32097__HA

SEQ ID NO: 13828 - RNA, 1701 nt, Artificial Sequence; identical to SEQ ID NO: 13292
  derived and/or modified CDS sequence (AUadapt) from InfluenzaA__ALE32099__HA
